United States Patent 11,931,406 (FLAVIVIRUS VACCINE) - sequence listing, part 42

SEQ ID NO: 15831 - RNA, 9879 nt, Artificial Sequence
  derived and/or modified CDS sequence (opt4) from DENV-1__JX669468__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcaacggcaucuucgugaccaacgaggugcacaccuggaccgagcaguacaaguuccaggccgacagccccaagagacugagcgccgccaucggcagagccugggaggagggcgugugcggcaucagaagcgccaccagacuggagaacaucauguggaagcagaucagcaacgagcugaaccacauccugcuggagaacgacaucaaguucaccgugguggugggcaacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgagcagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauguacggcggccccaucagccagcacaacuacagacccggcuacuucacccagaccgccggccccuggcaccugggcaagcuggagcuggacuucgaccugugcgagggcaccaccguggugguggacgagcacugcggcagcagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacaagaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccaccgugcugagcaucgugagccuguucccccugugccugagcaccaccagccagaagaccaccuggcugcccgugcugcugggcagcuucggcugcaagccccugaccauguuccugaucaccgagaacgagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggaccugggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuucuuccccagcgagcuggagagccccaaccuggccgagagagugcuggacuggcuggagaagcacggcgccgagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15832 - RNA, 9879 nt, Artificial Sequence
  derived and/or modified CDS sequence (opt4) from DENV-1__JX669469__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucaaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcagagccugggaggagggcgugugcggcaucagaagcgccaccagacuggagaacaucauguggaagcagaucagcaacgagcugaaccacauccugcuggagaacgacaucaaguucaccgugguggugggcaacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgagcagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauguacggcggccccaucagccagcacaacuacagacccggcuacuucacccagaccgccggccccuggcaccugggcaagcuggagcuggacuucgaccugugcgagggcaccaccguggugguggacgagcacugcggcagcagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucauggcccagcugaccuggaacgaccugaucagacugugcaucauggugggcgccaacgccagcgacaagaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacgagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccauccuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggaccugggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuucuuccccagcgagcuggagagccccaaccuggccgagagagugcuggacuggcuggagaagcacggcgccgagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15833 - RNA, 9879 nt, Artificial Sequence
  derived and/or modified CDS sequence (opt4) from DENV-1__JX669470__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucguggugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcagagccugggaggagggcgugugcggcaucagaagcgccaccagacuggagaacaucauguggaagcagaucagcaacgagcugaaccacauccugcuggagaacgacaucaaguucaccgugguggugggcaacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgagcagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauguacggcggccccaucagccagcacaacuacagacccggcuacuucacccagaccgccggccccuggcaccugggcaagcuggagcuggacuucgaccugugcgagggcaccaccguggugguggacgagcacugcggcagcagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacaagaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacgagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguaccuguggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggaccugggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugagaaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuucuuccccagcgagcuggagagccccaaccuggccgagagagugcuggacuggcuggagaagcacggcgccgagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15834 - RNA, 9879 nt, Artificial Sequence
  derived and/or modified CDS sequence (opt4) from DENV-1__JX669471__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcagagccugggaggagggcgugugcggcaucagaagcgccaccagacuggagaacaucauguggaagcagaucagcaacgagcugaaccacauccugcuggagaacgacaucaaguucaccgugguggugggcaacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgagcagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauguacggcggccccaucagccagcacaacuacagacccggcuacuucacccagaccgccggccccuggcaccugggcaagcuggagcuggacuucgaccugugcgagggcaccaccguggugguggacgagcacugcggcagcagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacaagaugggcaugggcaccaccuaccuggcccugauggccacccugaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacgagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgugcccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggaccugggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgacagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuucuuccccagcgagcuggagagccccaaccuggccgagagagugcuggacuggcuggagaagcacggcgccgagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15835 - RNA, 9879 nt, Artificial Sequence
  derived and/or modified CDS sequence (opt4) from DENV-1__JX669472__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcagagccugggaggagggcgugugcggcaucagaagcgccaccagacuggagaacaucauguggaagcagaucagcaacgagcugaaccacauccugcuggagaacgacaugaaguucaccgugguggugggcaacgccaacggcauccuggcccagggcaagaagaugaucaagccccagcccauggagcacaaguacagcuggaagagcuggggcaaggccaagaucaucggcgccgacauccagaacaccaccuucaucaucgacggccccgacacccccgagugccccgacgagcagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauguacggcggccccaucagccagcacaacuacagacccggcuacuucacccagaccgccggccccuggcaccugggcaagcuggagcuggacuucgaccugugcgagggcaccaccguggugguggacgagcacugcggcagcagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacaagaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccaccgugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggaccugggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuucuuccccagcgagcuggagagccccaaccuggccgagagagugcuggacuggcuggagaagcacggcgccgagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15836 - RNA, 9879 nt, Artificial Sequence
  derived and/or modified CDS sequence (opt4) from DENV-1__JX669473__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccagcagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcagagccugggaggagggcgugugcggcaucagaagcgccaccagacuggagaacaucauguggaagcagaucagcaacgagcugaaccacauccugcuggagaacgacaugaaguucaccgugguggugggcaacgccaacggcauccuggcccagggcaagaagaugaucaagccccagcccauggagcacaaguacagcuggaagagcuggggcaaggccaagaucaucggcgccgacauccagaacgccaccuucaucaucgacggccccgacacccccgagugccccgacgagcagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauguacggcggccccaucagccagcacaacuacagacccggcuacuucacccagaccgccggccccuggcaccugggcaagcuggagcuggacuucgaccugugcgagggcaccaccguggugguggacgagcacugcggcagcagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacaagaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccaccgugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggaccugggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuucuuccccagcgagcuggagagccccaaccuggccgagagagugcuggacuggcuggagaagcacggcgccgagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15837 - RNA, 9879 nt, Artificial Sequence
  derived and/or modified CDS sequence (opt4) from DENV-1__JX669474__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcagagccugggaggagggcgugugcggcaucagaagcgccaccagacuggagaacaucauguggaagcagaucagcaacgagcugaaccacauccugcuggagaacgacaugaaguucaccgugguggugggcaacgccaacggcauccuggcccagggcaagaagaugaucaagccccagcccauggagcacaaguacagcuggaagagcuggggcaaggccaagaucaucggcgccgacauccagaacgccaccuucaucaucgacggccccgacacccccgagugccccgacgagcagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauguacggcggccccaccagccagcacaacuacagacccggcuacuucacccagaccgccggccccuggcaccugggcaagcuggagcuggacuucgaccugugcgagggcaccaccguggugguggacgagcacugcggcagcagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacaagaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccaccgugcugagcaucgugagccuguucccccugugccugagcaccaccagccagaagaccaccuggcugcccgugcugcugggcagcuucggcugcaagccccugaccauguuccugaucaccgagaacgagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccaucagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggaccugggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuucuuccccagcgagcuggagagccccaaccuggccgagagagugcuggacuggcuggagaagcacggcgccgagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15838 - RNA, 9879 nt, Artificial Sequence
  derived and/or modified CDS sequence (opt4) from DENV-1__JX669475__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaucaaguucaccgugguggugggcaacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgagcagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauguacggcggccccaucagccagcacaacuacagacccggcuacuucacccagaccgccggccccuggcaccugggcaagcuggagcuggacuucgaccugugcgagggcaccaccguggugguggacgagcacugcggcagcagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacaagaugggcaugggcaccaccuaccuggcccugauggccaccuucaagaugagacccauguucgccgugggccugagcuucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacgagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggaccugggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuucuuccccagcgagcuggagagccccaaccuggccgagagagugcuggacuggcuggagaagcacggcgccgagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15839 - RNA, 9879 nt, Artificial Sequence
  derived and/or modified CDS sequence (opt4) from DENV-1__JX669461__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggccuguucaccagcgugggcaagcugauccaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaacuacauccugcuggagaacgacaugaaguucaccgugguggugggcgacgugaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagccacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcuacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagauggacagcuucagccugggcauccugugcgugagcauccugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacaagaugggcaugggcaccaccuaccuggcccugauggccacccugaagaugagacccauguucgccgugggccugcuguucagaagacugaccagcagagaggugcugcugcugaccgugggccugagccugguggccagcguggagcugcccaacagccuggaggagcugggcgacggccuggccaugggcaucaugaugcugaagcugcugaccgacuuccagccccaccagcuguggaccacccugcugagccugaccuucaucagaaccagccugagccuggacuacgccuggaagaccauggccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccacccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggagggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucgugaccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagaagagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccaagaaggugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15840 - RNA, 9879 nt, Artificial Sequence
  derived and/or modified CDS sequence (opt4) from DENV-1__KF184975__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccgaggaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcauccaggacgagaagggcgugauccagaacggcagacugaucaccgccaaccccaucgugaccgacaaggagaagcccgugaacaucgagaccgagccccccuucggcgagagcuacaucguggugggcgccggcgagaagacccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacgugauguggaagcagaucagcaacgagcugaaccacauccugcuggagaacgacaugaaguucaccgugguggugggcgacgugaacggcauccuggcccagggcaagaagauggugagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaccagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugagaagcauggugagcgccggcagcggcgagguggacaacuucagccugggccugcugugcgugagcaucaugguggaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucgugaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgccagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgaggccgagaaggccgugcuggacgacggcaucuacagaauccugcagagaggccugcugggcagaagccaggugggcgugggcguguuccaggacggcguguuccacaccauguggcacgugaccagaggcgccgugcugauguaccagggcaagagaguggagcccagcugggccagcgugaagaaggaccugaucagcuacggcggcggcuggagauuccagggccuguggaacaccggcgaggaggugcaggugaucgccguggagcccggcaagaaccccagaaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagaccgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcauggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcagacugccccagcaccugacccugaaggcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaucauccugaccguggccgccaacgagaugggccugcuggagaccaccaagaaggaccugggcaucggccacguggccgccgaggaccaccagcacgccaccaugcuggacguggaccugagacccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacaccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucaccgagguggacagaagcgaggccaaggagggccugaagagaggcgagaccaccaagcacgccgugagcagaggcgccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15841 - RNA, 9879 nt, Artificial Sequence
  derived and/or modified CDS sequence (opt4) from DENV-1__KT831765__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaaccacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauacagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggcaugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccaucaacaugaccagcagaaugcugcugaacagauucaccauggcccacagaaagcccaccuacgagagagacguggaccugggcgccggcaccagacacgugaccguggagcccgagguggccaaccuggacaucaucggccagagaaucgagaacaucaagugcgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagaucagcggcggcaacauguacgccgacgacaccgccggcugggacaccagaaucaccgaggacgaccugcagaacgaggccaagaucaccgagaucauggagcccgagcacgcccagcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15842 - RNA, 9879 nt, Artificial Sequence
  derived and/or modified CDS sequence (opt4) from DENV-1__KP188567__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggccuguucaccagcgugggcaagcugauccaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaacuacauccugcuggagaacgacaugaaguucaccgugguggugggcgacgugaacggcauccuggcccagggcaagaagaugaucaagccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagccacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcuacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcauccugaucgaggaggugaugagaagcagauggagcagaaagaugcugaugaccggcacccuggccguguuccugcugcugaucaugggccagcugaccuggaacgaccugaucagacugugcaucauggugggcgccaacgcccuggacagaaugggcaugggcaccaccuaccuggcccugauggccaccuucaagaugagacccauguucgccgugggccugcuguucagaagacugaccagcagagaggugcugcugcugaccgugggccugagccugguggccagcguggagcugcccagcagccuggaggagcugggcgacggccuggccaugggcaucaugaugcugaagcugcugaccgacuuccagccccaccagcuguggaccacccugcugagccugaccuucaucagaaccagccugagccuggacuacgccuggaagaccauggccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccacccaggagggcacccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggagggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucgugaccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagaagagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccaagaaggugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgccgacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15843 - RNA, 9879 nt, Artificial Sequence
  derived and/or modified CDS sequence (opt4) from DENV-1__KP188568__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggccuguucaccagcgugggcaagcugauccaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagccacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcuacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagauggacagcuucagccugggcauccugugcgugagcauccugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccgugggccugagccugguggccagcguggagcugcccaacagccuggaggagcugggcgacggccuggccaugggcaucaugaugcugaagcugcugaccgacuuccagccccaccagcuguggaccacccugcugagccugaccuucaucagaaccagccugagccuggacuacgccuggaagaccauggccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccacccaggagggcccccugcccgagaucgaggacgagguguucaagaagagaaaccugaccaucauggaccugcaccccggcagcggcaagaccagaagauaccugcccagcaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgccauccaggacgaggagagagacauccccgagagaagcuggaacaccggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggagggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggguggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucgugaccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagcgugaugaagagccugggcggcggcagaagaggcaccggcgcccagggcgagacccugggcgagaaguggaagagacagcugaaccagcugagcaagagcgaguucaacaccuacaagaagagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccaagaaggugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15844 - RNA, 9879 nt, Artificial Sequence
  derived and/or modified CDS sequence (opt4) from DENV-1__KF971870__SS-prME
agcgugaccaugcugcugaugcugaugcccaccgcccuggccuuccaccugaccaccagaggcggcgagccccacaugauggugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcagcgccaucaaggacagcaaggccgugcacgccgacaugggcuacuggaucgagagcgagaagaacgacaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaucggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcgccgagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguucccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagagagaagcugagacccagauggcugggcgccagaaccuacagcgacccccuggcccugagagacuucaaggaguucgccgccggcagaagaagcgugagcggcgaccugauccuggagaucggcaagcugccccagcaccugacccagagagcccagaacgcccuggacaaccuggugaugcugcacaacagccagcagggcggcagagccuacacccacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagaagacugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucaucgacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcugggcaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcaacugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15845 - RNA, 9879 nt, Artificial Sequence
  derived and/or modified CDS sequence (opt4) from DENV-1__KF971871__SS-prME
agcgugaccaugcugcugaugcugaugcccaccgcccuggccuuccaccugaccaccagaggcggcgagccccacaugauggugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgacaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaucggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcgccgagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguucccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcugggcgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagaagacugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucaucgacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcugggcaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcaacugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15846 - RNA, 9879 nt, Artificial Sequence
  derived and/or modified CDS sequence (opt4) from DENV-1__KF971869__SS-prME
agcgugaccaugcugcugaugcugaugcccaccgcccuggccuuccaccugaccaccagaggcggcgagccccacaugauggugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgacaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaucggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcgccgagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguucccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagaagacugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucaucgacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcugggcaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcaacugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15847 - RNA, 9879 nt, Artificial Sequence
  derived and/or modified CDS sequence (opt4) from DENV-1__JN903578__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagguggugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuuccugauccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcagauucaagaagggcagcagcaucggcaagauguucgaggccaccgccagaggcgccagaagaauggccauccugggcgacaccgccugggacuucggcagcaucggcggcguguucaccagcgugggcaagcugauccaccagguguucggcaccgccuacggcgugcuguucagcggcgugagcuggaccaugaagaucggcaucggcauccugcugaccuggcugggccugaacagcagaagcaccagccugagcaugaccugcaucaccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgagaucaagaccugcaucuggcccaagagccacacccuguggagcaacggcgugcuggagagcgagaugaucauccccaagaucuacggcggccccaucagccagcacaaccacagacccggcuacuucacccagaccgccggccccuggcaccugggcaagcuggagcuggacuucgacgugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcgccgagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccaucaccaugauccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagaaggacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacggcgaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcagcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccaagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccaccaugaagagauucaagaacgagagcgaccccgagggcgcccugugguga

SEQ ID NO: 15848 - RNA, 9879 nt, Artificial Sequence
  derived and/or modified CDS sequence (opt4) from DENV-1__JN903579__SS-prME
agcgugaccaugcugcugaugcugcugcccaccgcccuggccuuccaccugaccaccagaggcggcgagccccacaugaucgugggcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacaccggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcgccgagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccaucgccaugauccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccaucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggcagccuguucaugauccugaccguggccgccaacgagaugggccugcuggagaccaccaagaaggaccugggcaucggccacgugguggccgagaaccaccaccacgccaccacccuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccuguacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaccaccagcaugaagagauucaagaacgagagcgaccccgagggcgcccugugguga

SEQ ID NO: 15849 - RNA, 9879 nt, Artificial Sequence
  derived and/or modified CDS sequence (opt4) from DENV-1__JN903580__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaaacaccagccugagcaugaccugcaucgccgugggcauggugacccuguaccugggcgugauggugcaggccgacaccggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugaagagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcgccgagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccaucgccaugauccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccaucagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguucagaaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagagacaccggcgcccagggcgagacccugggcgagaaguggaagagacagcugaaccagcugagcaagcccgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaauggagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccuguacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgaccccgagggcgcccugugguga

SEQ ID NO: 15850 - RNA, 9879 nt, Artificial Sequence
  derived and/or modified CDS sequence (opt4) from DENV-1__JN903581__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaaacaccagccugagcaugaccugcaucgccgugggcauggugacccuguaccugggcgugauggugcaggccgacaccggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgugaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggaggaggaggagaaccuggugagaagcauggugagcgccggcagcggcgagguggacagcuucagccugggccugcugugcgugagcaucaugaucgaggaggugaugaagagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcgccgagcugcccaacagccuggaggagcugggcgacggccuggccaugggcaucaugaugcugaagcugcuggccgacuuccagagccaccagcuguggaccacccugcugagccugaccuucaucaagaccacccugagccuggacuacgccuggaagaccaucgccaugauccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccaucagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcgacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccuggagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagagagaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgugaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccuguacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgaccccgagggcgcccugugguga

SEQ ID NO: 15851 - RNA, 9879 nt, Artificial Sequence
  derived and/or modified CDS sequence (opt4) from DENV-1__KX380796__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagaugcagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaccgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucaacggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagccccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcagauucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15852 - RNA, 9879 nt, Artificial Sequence
  derived and/or modified CDS sequence (opt4) from DENV-1__KX380799__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcagauucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15853 - RNA, 9879 nt, Artificial Sequence
  derived and/or modified CDS sequence (opt4) from DENV-1__KX380800__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccaucuucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15854 - RNA, 9879 nt, Artificial Sequence
  derived and/or modified CDS sequence (opt4) from DENV-1__KX380802__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagaugggcaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15855 - RNA, 9879 nt, Artificial Sequence
  derived and/or modified CDS sequence (opt4) from DENV-1__KX380797__SS-prME
agcgugaccgugcugcugaugcugcugcccaccgcccuggccuuccaccugaccaccagaggcggcgagccccacaugaucgugagcaagcaggagagaggcaagagccugcuguucaagaccagcaccggcgugaacaugugcacccugaucgccauggaccugggcgagcugugcgaggacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaacccugguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccuucaccagccaggacgagaagggcgugacccagaacggcagacugaucaccgccaaccccaucgugaccgacaaggagaagcccgugaacaucgaggccgagccccccuucggcgagagcuaccugguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcugauccaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugaacggcauccuggcccagggcaagaagaugaucagaccccagcccauggagcacaaguacagcuggaagagcuggggcaaggccaaggugaucggcgccgacgugcagaacagcaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcugaccagagccagcuucaucgaggugaagaccugcguguggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucggccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacaagaugggcaugggcaccaccuaccuggcccugauggccaccuucagaaugagacccauguucgccgugggccugcuguucagaagacugaccagcagagaggugcugcugagaagcgugggccugagccugguggccagcguggagcugcccaacagccuggaggagcugggcgacggccuggccaugggcaucaugaugcugaagcugcugaccgacuuccagagccaccagcugugggccgcccugcugagccugaccuucgugaagaccaccuucagccugcacuacgccuggaagaccauggccaugauccugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccaucagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcaagagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcauggaggccuucccccagagcaacgccgccauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagaguggugcagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagagccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugaccaagagcgaguucaacaccuacaagagaagcggcaucaucgagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaaggugcugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcaucgagagacugaagagaauggccaucagcggcgacgacugcguggugaagcccguggacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15856 - RNA, 9879 nt, Artificial Sequence
  derived and/or modified CDS sequence (opt4) from DENV-1__KX380805__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccaucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggccugcugagcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaacaucgugaagcugcacagcggcagagacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15857 - RNA, 9879 nt, Artificial Sequence
  derived and/or modified CDS sequence (opt4) from DENV-1__KX380798__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15858 - RNA, 9879 nt, Artificial Sequence
  derived and/or modified CDS sequence (opt4) from DENV-1__KJ649286__SS-prME
agcgugaccaugcugcugaugcugcugcccaccgugcuggccuuccaccugaccaccagaggcggcgagccccacaugaucgugaccaagcaggagagaggcaagagccugcuguucaagaccagcaccggcgugaacaugugcacccugaucgccauggaccugggcgagcugugcgaggacaccaugaccuacaagugccccagaaucaccgaggccgagcccgacgacaucgacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaccgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccaccaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggaggugguggagacccagcacggcaccgugcuggugcaggugaaguacgagggcaccgacgcccccugcaagauccccuuccugacccaggacgagaagggcgugacccagaacggcagagugaucaccgccaaccccaucgugaccgacaaggagaagcccgugaacaucgaggccgagccccccuucggcgagagcuacaucguggugggcgccggcgagaaggcccugaagcugagcugguucaagaagggcagcaccaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugagcggcauccuggcccagggcaagaagaugaucagaccccagcccauggagcacaaguacagcuggaagagcuggggcaaggccaagaucaucggcgccgacgugcagaacagcaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcguguggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccgcccugcugagccugaccuucaucaagaccaccugcagccugcacuacgccuggaagaccauggccauggugcugagcaucgugagccuguucccccugugcaugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugguggccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguacaagggcaagagacuggagcccaccugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagagcgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcaugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaaccccaugacccugaccgccgccgugcugaugcugguggcccacuacaccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucaucgagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggcgccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccaggugauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacagacugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggccuguucagccccagcgagcuggagacccccaaccuggccgagagagugcugaacuggcugggcaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgagaacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaaagcugaucggcaacgagaacuaccuggacuacaugaccagcaugaagagauucaagaacgacagcgaccccgagggcgcccugugguga

SEQ ID NO: 15859 - RNA, 9879 nt, Artificial Sequence
  derived and/or modified CDS sequence (opt4) from DENV-1__KF887994__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagaugcuggaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaucggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugauggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccugguacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagcuucagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacguggugagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggccuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaaagcugaucggcaacgagaacuaccuggacuacaugaccagcaugaagagauucaagaacgagagcgaccccgagggcgcccugugguga

SEQ ID NO: 15860 - RNA, 9879 nt, Artificial Sequence
  derived and/or modified CDS sequence (opt4) from DENV-1__JQ675358__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagagaagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaccuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagccugcugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccuggugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccagaaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacaccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagcgugggcggcggcagaagaggcaugggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugcacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15861 - RNA, 9879 nt, Artificial Sequence
  derived and/or modified CDS sequence (opt4) from DENV-1__FJ850070__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggccuguucaccagcgugggcaagcugauccaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaacuacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagccacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcuacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcauccugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagccccaccagcuguggaccacccugcugagccugaccuucaucagaaccagccugagccuggacuacgccuggaagaccauggccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgccagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucgugaccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagaagagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagagcagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccaagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15862 - RNA, 9879 nt, Artificial Sequence
  derived and/or modified CDS sequence (opt4) from DENV-1__FJ850071__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggccuguucaccagcgugggcaagcugauccaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaacuacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagccacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcuacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcauccugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaaagcugaccagcagagaggugcugcugcugaccaucggccugagccugguggccagcguggagcugcccaacagccuggaggagcugggcgacggccuggccaugggcaucaugaugcugaagcugcugaccgacuuccagccccaccagcuguggaccacccugcugagccugaccuucaucagaaccagccugagccuggacuacgccuggaagaccauggccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucgugaccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagaagagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccaagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15863 - RNA, 9879 nt, Artificial Sequence
  derived and/or modified CDS sequence (opt4) from DENV-1__FJ850073__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcagagccugggaggagggcgugugcggcaucagaagcgccaccagacuggagaacaucauguggaagcagaucagcaacgagcugaaccacauccugcuggagaacgacaucaaguucaccgugguggugggcaacgccgacggcauccuggcccagggcaagaagaugaucagaccccagcccauggagcacaaguacagcuggaagagcuggggcaaggccaagaucaucggcgccgacauccagaacaccaccuucaucaucgacggccccgacacccuggagugccccgacgagcagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauguacggcggccccgugagccagcacaacuacagacccggcuacuucacccagaccgccggccccuggcaccugggcaagcuggagcuggacuucgaccugugcgagggcaccaccguggugguggacgagcacugcggcagcagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcgugcugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacaagaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacgagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggagguggagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugauggccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggaccugggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugagaaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuucuucagcagcgagcuggagagccccaaccuggccgagagagugcuggacuggcuggagaagcacggcgccgagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacggcaacuaccuggacuacaugaccagcaugaagagauucaagaacgagagcgaccccgagggcgcccugugguga

SEQ ID NO: 15864 - RNA, 9879 nt, Artificial Sequence
  derived and/or modified CDS sequence (opt4) from DENV-1__FJ850075__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggccuguucaccagcgugggcaagcugauccaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaacuacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagccacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcuacagaggccccagccugagaaccaccaccgugaccggcaagaccauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcauccugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagccccaccagcuguggaccacccugcugagccugaccuucaucagaaccagccugagccuggacuacgccuggaagaccauggccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucgugaccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagaagagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccaagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15865 - RNA, 9879 nt, Artificial Sequence
  derived and/or modified CDS sequence (opt4) from DENV-1__FJ850077__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgagguggagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcaggugcagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggccuguucaccagcgugggcaagcugauccaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaacuacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaccagccagcacaacuacagacccggcuacuucacccagaccgccggccccuggcaccugggcaagcuggagcuggacuucgaccugugcgagggcaccaccguggugguggacgagcacugcggcuacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcauccugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaaagcugaccagcagagaggugcugcugcugaccaucggccugagccugguggccagcguggagcugcccaacagccuggaggagcugggcgacggccuggccaugggcaucaugaugcugaagcugcugaccgacuuccagccccaccagcuguggaccacccugcugagccugaccuucaucagaaccagccugagccuggacuacgccuggaagaccauggccauggcccugagcaucgugagccuguucccccugugccugagcaccaccagccagaagaccaccuggcugcccgugcugcugggcagcuucggcugcaagccccugaccauguuccugaucaccgagaacagaaucuggggcagaaagagcuggcccaucaacgagggcgugauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccaccgugcugaugcugguggcccacuacgccaucaucggccccggccugcaggccaaggccaccagagaggcccagaagagaaccgccgccggcaucaugaagaaccccaccguggacggcaucgugaccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagaagagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccaagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagacaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15866 - RNA, 9879 nt, Artificial Sequence
  derived and/or modified CDS sequence (opt4) from DENV-1__FJ850081__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggccuguucaccagcgugggcaagcugauccaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaacuacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagccacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcuacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcauccugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagccccaccagcuguggaccacccugcugagccugaccuucaucagaaccagccugagccuggacuacgccuggaagaccauggccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcgccgaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucgugaccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagaagagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccaagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15867 - RNA, 9879 nt, Artificial Sequence
  derived and/or modified CDS sequence (opt4) from DENV-1__FJ850084__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgagguggagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggccuguucaccagcgugggcaagcugauccaccagguguucggcgccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaacuacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaccagccagcacaacuacagacccggcuacuucacccagaccgccggccccuggcaccugggcaagcuggagcuggacuucgaccugugcgagggcaccaccguggugguggacgagcacugcggcuacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcgccgagguggacagcuucagccugggcauccugugcgugagcauccugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaaagcugaccagcagagaggugcugcugcugaccaucggccugagccugguggccagcguggagcugcccaacagccuggaggagcugggcgacggccuggccaugggcaucaugaugcugaagcugcugaccgacuuccagccccaccagcuguggaccacccugcugagccugaccuucaucagaaccagccugagccuggacuacgccuggaagaccauggccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccaccgugcugaugcugguggcccacuacgccaucaucggccccggccugcaggccaaggccaccagagaggcccagaagagaaccgccgccggcaucaugaagaaccccaccguggacggcaucgugaccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagaagagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccaagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagacaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15868 - RNA, 9879 nt, Artificial Sequence
  derived and/or modified CDS sequence (opt4) from DENV-1__FJ850087__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggccuguucaccagcgugggcaagcugauccaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaacuacauccugcuggagaacgacaugaaguucaccgugguggugggcgacgugaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagccacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcuacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcauccugaucgaggaggugaugagaagcagauggagcagaaagaugcugaugaccggcacccuggugguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccgugggccugagccugguggccagcguggagcugcccaacagccuggaggagcugggcgacggccuggccaugggcaucaugaugcugaagcugcugaccgacuuccagccccaccagcuguggaccacccugcugagccugaccuucaucagaaccagccugagccuggacuacgccuggaagaccauggccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcgugcugcaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccacccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggagggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucgugaccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagaagagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccaagaaggugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15869 - RNA, 9879 nt, Artificial Sequence
  derived and/or modified CDS sequence (opt4) from DENV-1__FJ850090__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgagguggagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugauccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggccuguucaccagcgugggcaagcugauccaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaacuacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagccacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaccagccagcacaacuacagacccggcuacuucacccagaccgccggccccuggcaccugggcaagcuggagcuggacuucgaccugugcgagggcaccaccguggugguggacgagcacugcggcuacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcauccugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaaagcugaccagcagagaggugcugcugcugaccaucggccugagccugguggccagcguggagcugcccaacagccuggaggagcugggcgacggccuggccaugggcaucaugaugcugaagcugcugaccgacuuccagccccaccagcuguggaccacccugcugagccugaccuucaucagaaccagccugagccuggacuacgccuggaagaccauggccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccaccgugcugaugcugguggcccacuacgccaucaucggccccggccugcaggccaaggccaccagagaggcccagaagagaaccgccgccggcaucaugaagaaccccaccguggacggcaucgugaccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagaagagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcugugggacuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccaagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagacaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15870 - RNA, 9879 nt, Artificial Sequence
  derived and/or modified CDS sequence (opt4) from DENV-1__FJ850093__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccacccaccuggcccugauggccaccuucaagaugagacccauguucgccgugggccugcuguucagaagacugaccagcagagaggugcugcugcugaccaucggccugagccugauggccagcauggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccaugauccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagaccaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagagagugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugaagggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15871 - RNA, 9879 nt, Artificial Sequence
  derived and/or modified CDS sequence (opt4) from DENV-1__GU131863__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggccuguucaccagcgugggcaagcugauccaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaacuacauccugcuggagaacgacaugaaguucaccgugguggugggcgacaucaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagccacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcuacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcauccugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccgugggccugagccugguggccagcguggagcugcccaacagccuggaggagcugggcgacggccuggccaugggcaucaugaugcugaagcugcugaccgacuuccagccccaccagcuguggaccacccugcugagccugaccuucaucagaaccagccugagccuggacuacgccuggaagaccauggccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccacccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggagggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucgugaccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagaagagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccaagaaggugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15872 - RNA, 9879 nt, Artificial Sequence
  derived and/or modified CDS sequence (opt4) from DENV-1__GQ868559__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgaggaggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15873 - RNA, 9879 nt, Artificial Sequence
  derived and/or modified CDS sequence (opt4) from DENV-1__GQ868560__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcaucaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgaggaggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuacaucgacuacaugaccagcaugaagagauucaagaacgagagcgaccccgagggcgcccugugguga

SEQ ID NO: 15874 - RNA, 9879 nt, Artificial Sequence
  derived and/or modified CDS sequence (opt4) from DENV-1__GQ868561__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccagccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaccaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15875 - RNA, 9879 nt, Artificial Sequence
  derived and/or modified CDS sequence (opt4) from DENV-1__GU131948__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagagauccugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaucuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcaucagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaccccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15876 - RNA, 9879 nt, Artificial Sequence
  derived and/or modified CDS sequence (opt4) from DENV-1__GQ868562__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcagcacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccacccaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgccacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugaagggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15877 - RNA, 9879 nt, Artificial Sequence
  derived and/or modified CDS sequence (opt4) from DENV-1__GQ868563__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacgccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaccagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggccuguggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacgccgccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgaggugcccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggagugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15878 - RNA, 9879 nt, Artificial Sequence
  derived and/or modified CDS sequence (opt4) from DENV-1__GQ868564__SS-prME
agcgugaccaugcugcugaugcugcugcccaccgcccuggccuuccaccugaccaccagaggcggcgagccccacaugaucgugagcaagcaggagagaggcaaggcccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagagagaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaccagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcacgaggccgagcacagcggcgccagccacaacauccugguggaggugcaggacgacggcaccaugaagaucaaggacgaggagagagacgacacccugaccauccugcugaaggccgcccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggagugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15879 - RNA, 9879 nt, Artificial Sequence
  derived and/or modified CDS sequence (opt4) from DENV-1__GQ868565__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacgccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaccagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggccuguggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacgccgccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggagugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15880 - RNA, 9879 nt, Artificial Sequence
  derived and/or modified CDS sequence (opt4) from DENV-1__GQ868568__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgugaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaucaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacacccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaccagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggagugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15881 - RNA, 9879 nt, Artificial Sequence
  derived and/or modified CDS sequence (opt4) from DENV-1__GQ868569__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgagguggccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacgccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaccagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggccuguggaacaugggcgaggaggugcaggugaucgccguggagcccggcaagaaccccagaaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacgccgccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggagugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15882 - RNA, 9879 nt, Artificial Sequence
  derived and/or modified CDS sequence (opt4) from DENV-1__GQ868570__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaaggugggcaucggcauccugcugaccuggcugggccugaacagcagaagcaccagccugagcaugaccugcaucgccgugggcauggugacccuguaccugggcgugauggugcaggccgaccugggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgugaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacacccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacaagcagagaaccccccaggacaaccagcuggccuacguggugaucggccugcuguucaugauccuggccguggccgccaacgagaugggccugcuggagaccaccaagaaggaccugggcaucggcuacguggccaccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccgccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15883 - RNA, 9879 nt, Artificial Sequence
  derived and/or modified CDS sequence (opt4) from DENV-1__KJ189302__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccagccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15884 - RNA, 9879 nt, Artificial Sequence
  derived and/or modified CDS sequence (opt4) from DENV-1__KJ189303__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgugaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacacccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaccagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggagugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15885 - RNA, 9879 nt, Artificial Sequence
  derived and/or modified CDS sequence (opt4) from DENV-1__KR028435__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaucugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccaucagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagggcggcaucagcgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucaucgacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15886 - RNA, 9879 nt, Artificial Sequence
  derived and/or modified CDS sequence (opt4) from DENV-1__JQ922548__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacaccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccagaaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaugagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccaggccaagaagcaggaggugguggugcugggcagccaggagggcgccaugcacaccgcccugaccggcgccaccgagauccagaccagcggcaccaccaccauguucgccggccaccugaagugcagacugaagauggacaagcugacccugaagggcgccagcuacgugaugugcaccggccccuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcgccuucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacgcccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcugaccagagccagcuucaucgaggugaagaccugcaccuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacggcggcgccagccugggcaccaccaccgugaccggcaagaucauccacgaguggugcugcagaagcugcacccugcccccccugagauuccugggcgaggacggcugcugguacggcauggagaucagacccgugaaggagaaggaggagaaccuguucagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaucggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccaucgccauggugcugagcaucgugagccuguucccccugugccugagcaccaccagccagaagaccaccuggcugcccgugcugcugggcagcuucggcagcaagccccugaccauguuccugaucaccgagaacaagaucuggggcagaaagagcuggccccugaacgagggcaucauggccgugggcaucgugagcauccugcugagcagccugcccaagaacgacgugccccuggccggcccccugaucgccggcggcaugcugaucgccugcuacgugaucagcggcagcagcgccgaccugagccuggagagagccgccgaggugagcugggaggaggaggccgagcacagcggcgccagccacaacauccugguggaggugcaggacgacggcaacaugaagaucaaggacgaggagagagacgacagccugaccauccugcugaaggccacccugcuggccgugagcggcguguaccccaugagcauccccgccacccuguucgugugguacuucuggcagaagaagaagcagagaagcggcgugcugugggacacccccagcccccccgagguggugagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaacuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacagcagaaccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugaaggagcugcugauccccgacgccgacggccagagaaccccccaggacaaccagcuggccuacguggugaucggccugcuguucaugauccugaccguggccgccaacgagaugggccugcuggagaccaccaagaagaaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcagacccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggccugaugaagaaccccaccguggacggcaucgccgccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcgccaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaacgagcacaagagcaccuggcacuacgacgaggacaaccccuacaagaccugggccuaccacggcaccuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagaacagcaaccuggccgagagagcccuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugcgagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccgugaacugggugcccaccagcagaaccaccuggagcauccacgcccaccaccaguggaugaccaccgaggacaugcugagcguguggaacagaguguggaucgaggagaaccccuggauggaggacaagacccacgugagcagcugggccgacgugcccuaccugggcaagagagaggaccaguggugcggcagccugaucggccuggccgccagagccaccugggccaccaacauccagguggcccugaaccaggugagaagacugaucggcaacgagaacuaccuggacuacaugaccagcaugaagagauucaagaacgagagcgaccccgagggcgcccugugguga

SEQ ID NO: 15887 - RNA, 9879 nt, Artificial Sequence
  derived and/or modified CDS sequence (opt4) from DENV-1__JQ922544__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcugcgagggcgccuggaagcagauccagaagguggagaucugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagaguucguggagggccugagcggcgccaccuggguggacguggugcuggagcacggcagcugccugcacaccauggcccagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccacccacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaucaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggaggagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucagcuucuucgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacgugaacaugggccagccccugaacaacgacgaggaccacgcccacuggaccgaggccaagaugcugcuggacaacaucaacacccccgagggcaucauccccgcccuguucgagcccgagagaaagaagagcgccgccguggacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagagagagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccaccaugcuggacguggaccugagacccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagccugauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaugggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacaagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacaagguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15888 - RNA, 9879 nt, Artificial Sequence
  derived and/or modified CDS sequence (opt4) from DENV-1__JQ922546__SS-prME
agcguggccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaaguggcccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaucaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcauccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacgugauguggaagcagaucagcaacgagcugaaccacauccugcuggagaacgacaugaaguucaccgugguggugggcgacgugaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccuguucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccauggccauggugcugagcaucgugagccugagcccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccagccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcaucuuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaucuucaagacccccgagggcgaggugggcgccaucacccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaugaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggagggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggaccacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacaccgacagaagauggugcuucgacggcgagagaaacaaccaggugcuggaggagaacauggacguggagaucuggauggaggagggcgagaagaagaagaucagacccagauggcuggagaucgagaaguacagcgacccccuggcccugagagaguucaaggaguucagcgccaagagaaagagcgugcugggcgaccugaagcuggagaucggcaagcugccccagcaccugaccaucaaggccagaaacgcccuggacaaccuggugaugcugcacaacagcgagcagggcggcaaggccuacagacacgccauggaggagcugcccgacaccaucgagacccugaugagacugggccugaucgccgugaugaccggcggcgugacccuguucuuccugagcggcaagggccugggcaagaccagcaacggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccccccagaucaugaagaaccagaucguggacggcaucguggccguggaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccaccgugacccagaucgccaugaccgacaccacccccuucggccagcagagaguguucaaggagaagguggacaccagaacccccaaggccaagagaggcaccgcccagaucauggaggugaccgccaacuggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcugaacuggcuggagaagcacggcguggagagacugaagagaauggccaucagcggcgacgacugcguggugaagcccaccgacgacagauucgccaccgcccugaccgcccugaacgacaugggcaaggugagaaaggacaccccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccacggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagcaucaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15889 - RNA, 9879 nt, Artificial Sequence
  derived and/or modified CDS sequence (opt4) from DENV-1__JQ922545__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacaccaucggcaccagcaucacccagaagggcaucaucuucauccugcugaugaccggcgcccccaucauggccaugagaugcgugggcaucggcaacagagacuucguggagggccugagcggcgcccccuggguggacguggugcuggagcacggcagcugccugagcaacauggccaagaacaagcccacccuggacaucgacuucuucaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaugagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccugccuggagaacaucauguggaagcagaucagcaacgagcugaaccacauccugcuggagaacgacaugaaguucaccgugguggugggcgacgccaacggcauccugacccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugagaagcauggugagcgccggcagcggcgagguggacagcuucagccugggccugcugugcgugagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgugagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgacuuccagagccaccagcuguggaccacccugcugagccugaccuucaucaagaccacccugagccuggacuacgccuggaagaccaucgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggcccagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcagcgacaucgccaccgugcuggagagaagcagagagcccgugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccccaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucgagaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucauccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgugguggccgagaaccaccaccacgccaccaugcuggacaucgaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagaucgccaaccuggacaucaucggccagagaaucgagaacaucaagaucggccacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagacccaagagaggcaccgcccagaucauggaggugaccgccaaguggauguggggcuuccuguucagaaacagaccccccagaaucugcaccagagacgaguucgccagaaaggugagaagcagcaccgccaacggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgacagcagcaacgaggccaagaucaucgagcugaugagacccgagcacgcccugcuggccaccagcaucuucaagcugaccuuccagaucagcguggugagagugcagagacccgccaagagcggcaccgugauggagugcaucagcagaagagaccagaagagaagcggccaggugggcaccuacggccugaacaccuucaccaacauggaggugcagcugaucagacagauggagagcgagggcaucuucagccccagcgagauggagaacagcaaccuggccgagagagugcuggacuggcuggagaagcacggcguggagagacugaagagaauggccaucagcggcgacgacugcguggugaagcccaccgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15890 - RNA, 9879 nt, Artificial Sequence
  derived and/or modified CDS sequence (opt4) from DENV-1__GU131887__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucagauacgagggcaccgacgcccccugcaagauccccuucagcacccaggacgagagaggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagcuucagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggagaagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgcccugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaucaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15891 - RNA, 9879 nt, Artificial Sequence
  derived and/or modified CDS sequence (opt4) from DENV-1__GU131888__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagagcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccggcugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggccccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgcccugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15892 - RNA, 9879 nt, Artificial Sequence
  derived and/or modified CDS sequence (opt4) from DENV-1__GU131892__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggugcagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15893 - RNA, 9879 nt, Artificial Sequence
  derived and/or modified CDS sequence (opt4) from DENV-1__GU131893__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgccacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggccugggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagccacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaagccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcugguguggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15894 - RNA, 9879 nt, Artificial Sequence
  derived and/or modified CDS sequence (opt4) from DENV-1__GU131894__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggacccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15895 - RNA, 9879 nt, Artificial Sequence
  derived and/or modified CDS sequence (opt4) from DENV-1__GU131895__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcuggcccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15896 - RNA, 9879 nt, Artificial Sequence
  derived and/or modified CDS sequence (opt4) from DENV-1__GQ868632__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgagcagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagagagaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagcuuccugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15897 - RNA, 9879 nt, Artificial Sequence
  derived and/or modified CDS sequence (opt4) from DENV-1__GQ868633__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgaggccaccaagcacgccgugagcagaggccccgccaagcugagaugguucguggagagaaaccuggugaaccccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugggugagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucuggagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15898 - RNA, 9879 nt, Artificial Sequence
  derived and/or modified CDS sequence (opt4) from DENV-1__GU131919__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuuccugacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcugauccaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccugcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15899 - RNA, 9879 nt, Artificial Sequence
  derived and/or modified CDS sequence (opt4) from DENV-1__GU131920__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacagagagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaagacugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15900 - RNA, 9879 nt, Artificial Sequence
  derived and/or modified CDS sequence (opt4) from DENV-1__GU131921__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugauggcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaugaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcgccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagaaggccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15901 - RNA, 9879 nt, Artificial Sequence
  derived and/or modified CDS sequence (opt4) from DENV-1__GQ868635__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugauggcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcgccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagaaggccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15902 - RNA, 9879 nt, Artificial Sequence
  derived and/or modified CDS sequence (opt4) from DENV-1__GQ868636__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugauggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggccugggcgagguggacagcuucagccugggccugcugugcaucagcaucaugaucgaggaggugaugagaagcagauggagcagaaagaugcugauggccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcaccacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcguggugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccaucagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagagaugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcagaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccagcaacauccagguggccaucaaccaggugagaagacugaucggcaacgagaacuaccuggacuacaugaccagcaugaagagauucaagaacgagggcgaccccgagggcgcccugugguga

SEQ ID NO: 15903 - RNA, 9879 nt, Artificial Sequence
  derived and/or modified CDS sequence (opt4) from DENV-1__GU131922__SS-prME
agcgugaucaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15904 - RNA, 9879 nt, Artificial Sequence
  derived and/or modified CDS sequence (opt4) from DENV-1__GU131923__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccgugguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcaucacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcaagagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgaggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15905 - RNA, 9879 nt, Artificial Sequence
  derived and/or modified CDS sequence (opt4) from DENV-1__GQ868637__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagagagaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaucgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgacgagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15906 - RNA, 9879 nt, Artificial Sequence
  derived and/or modified CDS sequence (opt4) from DENV-1__GQ868639__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucagcgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaugaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcuggccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcgccgaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagaucagcggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15907 - RNA, 9879 nt, Artificial Sequence
  derived and/or modified CDS sequence (opt4) from DENV-1__GU131925__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15908 - RNA, 9879 nt, Artificial Sequence
  derived and/or modified CDS sequence (opt4) from DENV-1__GU131926__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucagcgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggcgugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaugaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcgccgaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagaucagcggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15909 - RNA, 9879 nt, Artificial Sequence
  derived and/or modified CDS sequence (opt4) from DENV-1__FJ639669__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15910 - RNA, 9882 nt, Artificial Sequence
  derived and/or modified CDS sequence (opt4) from DENV-1__FJ639670__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgugagcagaaagaaccugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggaucgccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagcagcaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15911 - RNA, 9879 nt, Artificial Sequence
  derived and/or modified CDS sequence (opt4) from DENV-1__FJ639671__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacacccugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacggcaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacgugauguggagacagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacaccagcgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcagagccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgagaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15912 - RNA, 9879 nt, Artificial Sequence
  derived and/or modified CDS sequence (opt4) from DENV-1__JN819423__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacacccugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacggcaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcgugggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacgugauguggagacagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacaccagcgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcagagccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgagaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccagcaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15913 - RNA, 9879 nt, Artificial Sequence
  derived and/or modified CDS sequence (opt4) from DENV-1__FJ639672__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucagcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacgccuucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15914 - RNA, 9879 nt, Artificial Sequence
  derived and/or modified CDS sequence (opt4) from DENV-1__FJ639673__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagaagcugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccguggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15915 - RNA, 9879 nt, Artificial Sequence
  derived and/or modified CDS sequence (opt4) from DENV-1__FJ639674__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaugagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgugaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15916 - RNA, 9879 nt, Artificial Sequence
  derived and/or modified CDS sequence (opt4) from DENV-1__FJ639675__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggccuguucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcagcgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaugaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15917 - RNA, 9879 nt, Artificial Sequence
  derived and/or modified CDS sequence (opt4) from DENV-1__FJ639676__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgccggccugggccuggagaccagagccgagaccuggaugagcagcgagggcgccuggaagcagauccagagaguggagaccugggcccugagacaccccggcuucaccgugaucgcccuguuccuggcccacgugaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucgugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguucuucaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcaucagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcauccuggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuucaugaccagcaugaagagauucaagaacgagagcgacaccgagggcgcccugugguga

SEQ ID NO: 15918 - RNA, 9879 nt, Artificial Sequence
  derived and/or modified CDS sequence (opt4) from DENV-1__FJ639677__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagagugaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccaugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugaagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaagcaagaagcccagaaucugcaccagagaggaguucaucagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15919 - RNA, 9879 nt, Artificial Sequence
  derived and/or modified CDS sequence (opt4) from DENV-1__GQ868618__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15920 - RNA, 9879 nt, Artificial Sequence
  derived and/or modified CDS sequence (opt4) from DENV-1__GQ868619__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggugguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcauggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccaucauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugaugcuguucuuccugagcggcagaggccugggcaagaccagcaucggccugcugugcgugauggccagcagcggccugcuguggauggccagcguggagccccacuggaucgccgccagcaucauccuggaguucuuccugauggugcugcugauccccgagcccgacagacagagaaccccccaggacaaccagcuggccuacguggugaugggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15921 - RNA, 9879 nt, Artificial Sequence
  derived and/or modified CDS sequence (opt4) from DENV-1__FJ639678__SS-prME
agcgugaccaugcugcugaugcugaugcccaccgcccuggccuuccaccugaccaccagaggcggcgagccccacaugaucgugagcaagcaggagagaggcaaggcccugcuguucaagaccagcgccggcgugaacaugugcacccugaucgccauggaccugggcgagcugugcgaggacaccaugaccuacaagugccccagaaucaccgagguggagcccgacgacguggacugcuggugcaacgccaccgacaccugggugaccuacggcaccugcccccagaccggcgagcacagaagagacagaagaagcguggcccuggccccccacgugggccugggccuggagaccagagccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggaguacaaguacagcuggaagagcuggggcaaggccaagaucaucggcgccgacauccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguuccugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccaggagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagaaggcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccagacacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagcagggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugagaaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15922 - RNA, 9879 nt, Artificial Sequence
  derived and/or modified CDS sequence (opt4) from DENV-1__FJ639679__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgccagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15923 - RNA, 9879 nt, Artificial Sequence
  derived and/or modified CDS sequence (opt4) from DENV-1__FJ850069__SS-prME
agcgugaccaugcugcugaugcugaugcccaccgcccuggccuuccaccugaccaccagaggcggcgagccccacaugaucgugggcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagagaguggagaccugggcccugagacaccccggcuucaccgugaucgcccuguuccuggcccacgugaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggugacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguucuucaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcaucagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcauccuggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccggcuggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgacaccgagggcgcccugugguga

SEQ ID NO: 15924 - RNA, 9879 nt, Artificial Sequence
  derived and/or modified CDS sequence (opt4) from DENV-1__FJ639680__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccacaaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15925 - RNA, 9879 nt, Artificial Sequence
  derived and/or modified CDS sequence (opt4) from DENV-1__FJ639682__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaagacccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacguggccggcauccuggcccagggcaagaagaugaucagaccccagcccauggaguacaaguacagcuggaagagcuggggcaaggccaagaucaucggcgccgacgcccagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugcugagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcauccccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcaccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15926 - RNA, 9879 nt, Artificial Sequence
  derived and/or modified CDS sequence (opt4) from DENV-1__JQ287664__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacaccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagagaguggagaccugggcccugagacaccccggcuucaccgugaucgcccuguuccuggcccacgugaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacguggugggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguucuucaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaaaguaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcaucagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcauccuggagguggacagaagcgaggccaaggagggccugagaagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccuucgacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgacaccgagggcgcccugugguga

SEQ ID NO: 15927 - RNA, 9879 nt, Artificial Sequence
  derived and/or modified CDS sequence (opt4) from DENV-1__FJ639683__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagcuucagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagccuggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggccacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15928 - RNA, 9879 nt, Artificial Sequence
  derived and/or modified CDS sequence (opt4) from DENV-1__FJ639684__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucagcgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaugaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagaucagcggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgugcccgagggcgcccugugguga

SEQ ID NO: 15929 - RNA, 9879 nt, Artificial Sequence
  derived and/or modified CDS sequence (opt4) from DENV-1__FJ639685__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagcuucagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagcgugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccauccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15930 - RNA, 9879 nt, Artificial Sequence
  derived and/or modified CDS sequence (opt4) from DENV-1__FJ639686__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucagauacgagggcaccgacgcccccugcaagauccccuucagcacccaggacgagagaggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagcuucagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggagaagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaucaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15931 - RNA, 9879 nt, Artificial Sequence
  derived and/or modified CDS sequence (opt4) from DENV-1__FJ639687__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucagcgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaugaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcgccgaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagaucagcggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugaaggagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15932 - RNA, 9879 nt, Artificial Sequence
  derived and/or modified CDS sequence (opt4) from DENV-1__FJ639688__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacgugugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaccagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccugcugccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagauggccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucuaccaggugagaagacugaucggcaacgagaacuaccuggacuacaugaccagcaugaagagauucaagaacgagagcgaccccgagggcgcccugugguga

SEQ ID NO: 15933 - RNA, 9879 nt, Artificial Sequence
  derived and/or modified CDS sequence (opt4) from DENV-1__FJ639689__SS-prME
agcgugaccaugcugcugaugcugaugcccaccgcccuggccuuccaccugaccaucagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagcuucagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggagaagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcguguggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaccgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccgugggccugagccugguggccagcguggagcugcccaacagccuggaggagcugggcgacggccuggccaugggcaucaugauccugaagcugcugaccgacuuccagccccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcgugaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaucaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15934 - RNA, 9879 nt, Artificial Sequence
  derived and/or modified CDS sequence (opt4) from DENV-1__FJ639690__SS-prME
agcgugaccaugcugcugaugcugaugcccaccgcccuggccuuccaccugaccaucagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaucggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagcuucagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggagaagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcguguggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaccgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccgugggccugagccugguggccagcguggagcugcccaacagccuggaggagcugggcgacggccuggccaugggcaucaugauccugaagcugcugaccgacuuccagccccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaucaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15935 - RNA, 9879 nt, Artificial Sequence
  derived and/or modified CDS sequence (opt4) from DENV-1__FJ639691__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucagcgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaugaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagaucagcggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagaacccuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccuggagggcgcccugugguga

SEQ ID NO: 15936 - RNA, 9879 nt, Artificial Sequence
  derived and/or modified CDS sequence (opt4) from DENV-1__FJ639692__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagagcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgcccugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucaccgagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15937 - RNA, 9879 nt, Artificial Sequence
  derived and/or modified CDS sequence (opt4) from DENV-1__FJ639693__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucagcgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaugaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcgccgaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccgugggcuuccagaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagaucagcggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccggccccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15938 - RNA, 9879 nt, Artificial Sequence
  derived and/or modified CDS sequence (opt4) from DENV-1__FJ639694__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagcuucagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggagaagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaucaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcaacuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15939 - RNA, 9879 nt, Artificial Sequence
  derived and/or modified CDS sequence (opt4) from DENV-1__FJ639695__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggccugggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaagccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcugguguggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15940 - RNA, 9879 nt, Artificial Sequence
  derived and/or modified CDS sequence (opt4) from DENV-1__FJ639696__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucagcgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaugaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagaucagcggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagcccuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccuggagggcgcccugugguga

SEQ ID NO: 15941 - RNA, 9879 nt, Artificial Sequence
  derived and/or modified CDS sequence (opt4) from DENV-1__HM181937__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacaucgaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15942 - RNA, 9879 nt, Artificial Sequence
  derived and/or modified CDS sequence (opt4) from DENV-1__HM181939__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucagcgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaugaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccaucaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagaucagcggcggcaacauguacgccgacgacaccgccggcugggacaccagaaucaccgaggacgaccugcagaacgaggccaagaucaccgacaucauggagcccgagcacgcccugcuggccaacagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15943 - RNA, 9879 nt, Artificial Sequence
  derived and/or modified CDS sequence (opt4) from DENV-1__HM181942__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucagcgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaugaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagaucagcggcggcaacauguacgccgacgacaccgccggcugggacaccagaaucaccgaggacgaccugcagaacgaggccaagaucaccgacaucauggagcccgagcacgcccugcuggccaacagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15944 - RNA, 9879 nt, Artificial Sequence
  derived and/or modified CDS sequence (opt4) from DENV-1__HM488255__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagagcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcagaggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15945 - RNA, 9879 nt, Artificial Sequence
  derived and/or modified CDS sequence (opt4) from DENV-1__HM181944__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucagcgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaugaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagaucagcggcggcaacauguacgccgacgacaccgccggcugggacaccagaaucaccgaggacgaccugcagaacgaggccaagaucaccgacaucauggagcccgagcacgcccugcuggccaacagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15946 - RNA, 9879 nt, Artificial Sequence
  derived and/or modified CDS sequence (opt4) from DENV-1__HM181946__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucagauacgagggcaccgacgcccccugcaagauccccuucagcacccaggacgagagaggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagcuucagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggagaagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucgugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15947 - RNA, 9879 nt, Artificial Sequence
  derived and/or modified CDS sequence (opt4) from DENV-1__HM181948__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15948 - RNA, 9879 nt, Artificial Sequence
  derived and/or modified CDS sequence (opt4) from DENV-1__HM181949__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccggccacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcagaggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15949 - RNA, 9879 nt, Artificial Sequence
  derived and/or modified CDS sequence (opt4) from DENV-1__HM181950__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcgccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacagccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15950 - RNA, 9879 nt, Artificial Sequence
  derived and/or modified CDS sequence (opt4) from DENV-1__HM181952__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggugcagggcaagaagaugaucagaccccagcccauggaguacaaguacagcuggaagagcuggggcaaggccaagaucaucggcgccgacgugcagaacagcaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccaaggccagcuucaucgaggugaagaccugcaucuggcccaagagccacacccuguggagcaacggcgugcuggagagcgagaugaucauccccaagauccacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucguguggcacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcauggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucgugggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccaacgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagaaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgagcccgagggcgcccugugguga

SEQ ID NO: 15951 - RNA, 9879 nt, Artificial Sequence
  derived and/or modified CDS sequence (opt4) from DENV-1__HM181953__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggugcagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagcuggaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15952 - RNA, 9879 nt, Artificial Sequence
  derived and/or modified CDS sequence (opt4) from DENV-1__KF921933__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcaagugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacugggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacggcagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15953 - RNA, 9879 nt, Artificial Sequence
  derived and/or modified CDS sequence (opt4) from DENV-1__HM181954__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggacccccggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcgccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggccugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15954 - RNA, 9879 nt, Artificial Sequence
  derived and/or modified CDS sequence (opt4) from DENV-1__HM181955__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagagcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggugguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15955 - RNA, 9879 nt, Artificial Sequence
  derived and/or modified CDS sequence (opt4) from DENV-1__HM181959__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagagcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaaggugaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggugguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15956 - RNA, 9879 nt, Artificial Sequence
  derived and/or modified CDS sequence (opt4) from DENV-1__JF937651__SS-prME
agcgugaccaugcugcugaugcugaugcccaccgcccuggccuuccaccugaccaccagaggcggcgagccccacaugauccugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcugauccaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccugcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagcuaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaagaagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgugggcaaccaccaccacgccgccaugcuggacguggaccugcaccccgccagcgccuggacccuguacgccguggccaccaccaucaucacccccaugaugaagcacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccggcaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacuggauccccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccaagggcgcccugugguga

SEQ ID NO: 15957 - RNA, 9879 nt, Artificial Sequence
  derived and/or modified CDS sequence (opt4) from DENV-1__GU131956__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaccaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccauggugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15958 - RNA, 9879 nt, Artificial Sequence
  derived and/or modified CDS sequence (opt4) from DENV-1__GU131958__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuucgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15959 - RNA, 9879 nt, Artificial Sequence
  derived and/or modified CDS sequence (opt4) from DENV-1__GQ868499__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcggccacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaaggaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagccuggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaagguggccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15960 - RNA, 9879 nt, Artificial Sequence
  derived and/or modified CDS sequence (opt4) from DENV-1__GQ868500__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccauggugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucgugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugaagcagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucgugggcgagaaccaguggaacagcgccaaggaggccguggaggacgagagagugugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15961 - RNA, 9879 nt, Artificial Sequence
  derived and/or modified CDS sequence (opt4) from DENV-1__GU131961__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucagacuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuucgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgugcugugguga

SEQ ID NO: 15962 - RNA, 9870 nt, Artificial Sequence
  derived and/or modified CDS sequence (opt4) from DENV-1__GU131962__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaguacgccagcgccggccuggccaucaucgugccccugccccuggacaccuacggcagaaacagacugaagauccacagcggcaaggacguguucuucaugccccccgagaagggcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggaggcccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15963 - RNA, 9879 nt, Artificial Sequence
  derived and/or modified CDS sequence (opt4) from DENV-1__GU131963__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggaggcccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccaggugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15964 - RNA, 9879 nt, Artificial Sequence
  derived and/or modified CDS sequence (opt4) from DENV-1__KF955442__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgacggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuucgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15965 - RNA, 9879 nt, Artificial Sequence
  derived and/or modified CDS sequence (opt4) from DENV-1__GU131965__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggugcugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaaacaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgccaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15966 - RNA, 9879 nt, Artificial Sequence
  derived and/or modified CDS sequence (opt4) from DENV-1__GU131966__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacagaagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuucgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15967 - RNA, 9879 nt, Artificial Sequence
  derived and/or modified CDS sequence (opt4) from DENV-1__GQ868501__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaaccagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaagaccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccugauggccaccuacggcuggaaccugguggagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuucgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15968 - RNA, 9879 nt, Artificial Sequence
  derived and/or modified CDS sequence (opt4) from DENV-1__HQ166035__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagaucagacugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccaccaugcuggccgugagcggcguguaccccaugagcauccccgccacccccuucgugugguacuucuggcagaagaagaagcagagaaucagagugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagaggagaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggaggcccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15969 - RNA, 9879 nt, Artificial Sequence
  derived and/or modified CDS sequence (opt4) from DENV-1__GQ868502__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaccaucuucauccugcugaugcuggccacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaccgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccauggugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15970 - RNA, 9879 nt, Artificial Sequence
  derived and/or modified CDS sequence (opt4) from DENV-1__GQ868503__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccagaacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggagagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagagaaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaucuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuucgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15971 - RNA, 9879 nt, Artificial Sequence
  derived and/or modified CDS sequence (opt4) from DENV-1__GQ868504__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagggcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguaccccgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggaggcccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15972 - RNA, 9879 nt, Artificial Sequence
  derived and/or modified CDS sequence (opt4) from DENV-1__GU131967__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaccugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacggcgagcccaucccccuggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggaggcccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15973 - RNA, 9879 nt, Artificial Sequence
  derived and/or modified CDS sequence (opt4) from DENV-1__GU131968__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccagaacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggagagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagagaaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuucgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15974 - RNA, 9879 nt, Artificial Sequence
  derived and/or modified CDS sequence (opt4) from DENV-1__GQ868506__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccggcagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggaggcccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15975 - RNA, 9879 nt, Artificial Sequence
  derived and/or modified CDS sequence (opt4) from DENV-1__GQ868507__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaucacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccaugcccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccauggugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcccagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15976 - RNA, 9879 nt, Artificial Sequence
  derived and/or modified CDS sequence (opt4) from DENV-1__GQ868508__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaucacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccaugcccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccauggugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15977 - RNA, 9879 nt, Artificial Sequence
  derived and/or modified CDS sequence (opt4) from DENV-1__GQ868509__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaugagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgugaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguuccugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuucgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15978 - RNA, 9879 nt, Artificial Sequence
  derived and/or modified CDS sequence (opt4) from DENV-1__GQ868510__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcggccacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacauccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaaggaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcugggcaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15979 - RNA, 9879 nt, Artificial Sequence
  derived and/or modified CDS sequence (opt4) from DENV-1__GQ868511__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaccugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagaagaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacgccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagcuucugggaccuggugcacaaggagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacaugggcgugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15980 - RNA, 9879 nt, Artificial Sequence
  derived and/or modified CDS sequence (opt4) from DENV-1__GQ868512__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggaggcccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15981 - RNA, 9879 nt, Artificial Sequence
  derived and/or modified CDS sequence (opt4) from DENV-1__GU131970__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaccaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaaggaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccacccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugaaggagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15982 - RNA, 9879 nt, Artificial Sequence
  derived and/or modified CDS sequence (opt4) from DENV-1__KF955427__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgccuggaccggcgccaccgagauccagaccagcggcaccaccaccaucuucgccggccaccugaaguggagacugaagauggacaagcugacccugaagggcaccagcuacgugaugugcaccggcagcuucaagcuggagaaggagguggccgagacccagcacggcaccggccuggugcaggugaaguacgagggcaccgacgcccccugcaagauccccuucagcgcccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccugcccgacccccugaucgccggcggcauccugaucgccugcuacgugaucagcggcagcagcgccgaccugagccuggagaaggccgccgagaugagcugggagcaggaggccgagcacagcggcaccagccacaacauccugguggaggugcaggacgacggccccaugaagaucaaggacgaggagagagacgacacccugaccauccugcugaaggccacccugcuggccgugagcggcguguaccccaugagcauccccggcacccuguucgugugguacuucuggcagaagaagaagcagagaagcggcgugcugugggacacccccagcccccccaagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcaucagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15983 - RNA, 9879 nt, Artificial Sequence
  derived and/or modified CDS sequence (opt4) from DENV-1__GQ868513__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcccaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaucacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccaugcccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccauggugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15984 - RNA, 9879 nt, Artificial Sequence
  derived and/or modified CDS sequence (opt4) from DENV-1__GU131973__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagaugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggaggcccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15985 - RNA, 9879 nt, Artificial Sequence
  derived and/or modified CDS sequence (opt4) from DENV-1__GQ868517__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuucgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15986 - RNA, 9879 nt, Artificial Sequence
  derived and/or modified CDS sequence (opt4) from DENV-1__GU131976__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagccugaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugaaggcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuucgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcaccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15987 - RNA, 9879 nt, Artificial Sequence
  derived and/or modified CDS sequence (opt4) from DENV-1__GQ868518__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggccccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauucagaggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugaccagcagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15988 - RNA, 9879 nt, Artificial Sequence
  derived and/or modified CDS sequence (opt4) from DENV-1__GQ868519__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaucacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccaugcccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccauggugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15989 - RNA, 9879 nt, Artificial Sequence
  derived and/or modified CDS sequence (opt4) from DENV-1__KF955443__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaugagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgugaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguuccugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggacccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuucgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15990 - RNA, 9879 nt, Artificial Sequence
  derived and/or modified CDS sequence (opt4) from DENV-1__GQ868520__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccaugcccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccauggugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15991 - RNA, 9879 nt, Artificial Sequence
  derived and/or modified CDS sequence (opt4) from DENV-1__GQ868522__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaucacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccaugcccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccauggugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggcccccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15992 - RNA, 9879 nt, Artificial Sequence
  derived and/or modified CDS sequence (opt4) from DENV-1__HQ166036__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauucagaggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugaccagcagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15993 - RNA, 9879 nt, Artificial Sequence
  derived and/or modified CDS sequence (opt4) from DENV-1__GU131981__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucauggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaucacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccaugcccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccauggugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15994 - RNA, 9879 nt, Artificial Sequence
  derived and/or modified CDS sequence (opt4) from DENV-1__GQ868529__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaccgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaucgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccauggugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugaugcuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccugggccacgaggaccccauccccauggccaccuacggcuggaaccuggugaagcugcuggccggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15995 - RNA, 9879 nt, Artificial Sequence
  derived and/or modified CDS sequence (opt4) from DENV-1__GQ868531__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggaggcccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucagcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15996 - RNA, 9879 nt, Artificial Sequence
  derived and/or modified CDS sequence (opt4) from DENV-1__GU131983__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaucggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgaggagaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15997 - RNA, 9879 nt, Artificial Sequence
  derived and/or modified CDS sequence (opt4) from DENV-1__GQ868532__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaucacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcaacagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccaugcccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggccccccccccgagaucgaggacgagguguucaagaagagaaaccugaccaucauggaccugcaccccggcagcggcaagaccagaagauaccugcccgccauggugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcugacccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccaacgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacggcauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15998 - RNA, 9879 nt, Artificial Sequence
  derived and/or modified CDS sequence (opt4) from DENV-1__GQ868533__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucgaggccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguuccugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugaccagcagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggccaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagagcagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15999 - RNA, 9879 nt, Artificial Sequence
  derived and/or modified CDS sequence (opt4) from DENV-1__GQ868534__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagaacgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggaggcccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16000 - RNA, 9879 nt, Artificial Sequence
  derived and/or modified CDS sequence (opt4) from DENV-1__GQ868535__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgagguggccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaugggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuucgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16001 - RNA, 9879 nt, Artificial Sequence
  derived and/or modified CDS sequence (opt4) from DENV-1__KJ189306__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggccccuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagagagccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguuccacaucuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaucagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16002 - RNA, 9879 nt, Artificial Sequence
  derived and/or modified CDS sequence (opt4) from DENV-1__KJ189307__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccccguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagaacgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16003 - RNA, 9879 nt, Artificial Sequence
  derived and/or modified CDS sequence (opt4) from DENV-1__KJ189318__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaagaccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuucgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16004 - RNA, 9879 nt, Artificial Sequence
  derived and/or modified CDS sequence (opt4) from DENV-1__KJ189319__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuucgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16005 - RNA, 9879 nt, Artificial Sequence
  derived and/or modified CDS sequence (opt4) from DENV-1__KJ189320__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucaccgagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuucgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16006 - RNA, 9879 nt, Artificial Sequence
  derived and/or modified CDS sequence (opt4) from DENV-1__KJ189323__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggccccuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccagggcggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugagacccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16007 - RNA, 9879 nt, Artificial Sequence
  derived and/or modified CDS sequence (opt4) from DENV-1__KJ189324__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccagaagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgaggagaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16008 - RNA, 9879 nt, Artificial Sequence
  derived and/or modified CDS sequence (opt4) from DENV-1__KJ189325__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaccaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaucacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccaugcccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccauggugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16009 - RNA, 9879 nt, Artificial Sequence
  derived and/or modified CDS sequence (opt4) from DENV-1__KJ189326__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaccaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggccuguggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccauggugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16010 - RNA, 9879 nt, Artificial Sequence
  derived and/or modified CDS sequence (opt4) from DENV-1__KJ189327__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacacccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuucgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16011 - RNA, 9879 nt, Artificial Sequence
  derived and/or modified CDS sequence (opt4) from DENV-1__KJ189328__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaaggaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccacccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccaucgaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugaaggagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16012 - RNA, 9879 nt, Artificial Sequence
  derived and/or modified CDS sequence (opt4) from DENV-1__KJ189329__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacgccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagaagcggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugaccagcagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacagaaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16013 - RNA, 9879 nt, Artificial Sequence
  derived and/or modified CDS sequence (opt4) from DENV-1__KJ189331__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaucggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaagaccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggccaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuucgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16014 - RNA, 9879 nt, Artificial Sequence
  derived and/or modified CDS sequence (opt4) from DENV-1__KJ189332__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaccaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaagaccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggccaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuucgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16015 - RNA, 9879 nt, Artificial Sequence
  derived and/or modified CDS sequence (opt4) from DENV-1__KJ189334__SS-prME
agcgugaccaugcugcugaugcugcugcccaccgcccuggccuuccaccugaccaccagaggcggcgagccccacaugaucgugagcaagcaggagagaggcaagagccugcuguucaaggugagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagaacgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggaggcccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16016 - RNA, 9879 nt, Artificial Sequence
  derived and/or modified CDS sequence (opt4) from DENV-1__KJ189335__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagaacgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggaggcccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16017 - RNA, 9879 nt, Artificial Sequence
  derived and/or modified CDS sequence (opt4) from DENV-1__KJ189336__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcaucgugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggaggcccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16018 - RNA, 9879 nt, Artificial Sequence
  derived and/or modified CDS sequence (opt4) from DENV-1__KJ189337__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaucuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagagaaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuucgagagagacguggaccugggcgccggcaccagacacguggccguggagcccgagguggccaaccuggacaucaucggccagagaaucgagaacgugaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16019 - RNA, 9879 nt, Artificial Sequence
  derived and/or modified CDS sequence (opt4) from DENV-1__KJ189340__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccggcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggaggcccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16020 - RNA, 9879 nt, Artificial Sequence
  derived and/or modified CDS sequence (opt4) from DENV-1__KJ189341__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcggccacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggccccuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucguggugggcaucgugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacacccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaaggaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagcccagcaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcauccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagcugcacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16021 - RNA, 9879 nt, Artificial Sequence
  derived and/or modified CDS sequence (opt4) from DENV-1__KJ189343__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaccgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcguggugaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaucggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaagaccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggccaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuucgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16022 - RNA, 9879 nt, Artificial Sequence
  derived and/or modified CDS sequence (opt4) from DENV-1__KJ189344__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaccgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcguggugaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggaggcccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16023 - RNA, 9879 nt, Artificial Sequence
  derived and/or modified CDS sequence (opt4) from DENV-1__KJ189346__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaugagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugauggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguuccugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugaccagcagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggccaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccaccgcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacauccugcagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16024 - RNA, 9879 nt, Artificial Sequence
  derived and/or modified CDS sequence (opt4) from DENV-1__KJ189347__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggccccuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugauggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugagacccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcagaugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16025 - RNA, 9879 nt, Artificial Sequence
  derived and/or modified CDS sequence (opt4) from DENV-1__KJ189348__SS-prME
agcgugaccaugcugcugaugcugcugcccaccgcccuggccuuccaccugaccaccagaggcggcgagccccacaugaucgugagcaagcacgagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagcuucagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggcauccuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugagaaucaaggacgaggagaaggacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagagagaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagcccgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcugaacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16026 - RNA, 9879 nt, Artificial Sequence
  derived and/or modified CDS sequence (opt4) from DENV-1__KJ189368__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaacggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggccccuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcaucagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgaguucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagaguguucgacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16027 - RNA, 9879 nt, Artificial Sequence
  derived and/or modified CDS sequence (opt4) from DENV-1__KJ189369__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagaacgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgagaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16028 - RNA, 9879 nt, Artificial Sequence
  derived and/or modified CDS sequence (opt4) from DENV-1__EU482615__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagagcgagagcgaccccgagggcgcccugugguga

SEQ ID NO: 16029 - RNA, 9879 nt, Artificial Sequence
  derived and/or modified CDS sequence (opt4) from DENV-1__EU482616__SS-prME
agcgugaccaugcugcugaugcugcugcccaccgcccuggccuuccaccugaccaccagaggcggcgagccccacaugaucgugaacaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagaaggacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccaagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16030 - RNA, 9879 nt, Artificial Sequence
  derived and/or modified CDS sequence (opt4) from DENV-1__EU482618__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16031 - RNA, 9879 nt, Artificial Sequence
  derived and/or modified CDS sequence (opt4) from DENV-1__EU482619__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucaucgacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagagugaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugagaagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16032 - RNA, 9879 nt, Artificial Sequence
  derived and/or modified CDS sequence (opt4) from DENV-1__FJ898433__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaccgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgacagcugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaaggaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccacccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagaaggacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcugggcaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugaaggagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16033 - RNA, 9879 nt, Artificial Sequence
  derived and/or modified CDS sequence (opt4) from DENV-1__FJ547088__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacaccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaaguacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccggcagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16034 - RNA, 9879 nt, Artificial Sequence
  derived and/or modified CDS sequence (opt4) from DENV-1__FJ810419__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16035 - RNA, 9879 nt, Artificial Sequence
  derived and/or modified CDS sequence (opt4) from DENV-1__FJ547068__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccuggccgccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16036 - RNA, 9879 nt, Artificial Sequence
  derived and/or modified CDS sequence (opt4) from DENV-1__FJ562104__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacaccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaaguacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16037 - RNA, 9879 nt, Artificial Sequence
  derived and/or modified CDS sequence (opt4) from DENV-1__GQ199857__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucaucagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacaccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaaguacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucaucgacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16038 - RNA, 9879 nt, Artificial Sequence
  derived and/or modified CDS sequence (opt4) from DENV-1__GQ199858__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucaucagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacaccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccugggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaaguacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16039 - RNA, 9879 nt, Artificial Sequence
  derived and/or modified CDS sequence (opt4) from DENV-1__GQ199859__SS-prME
agcgugaccaugcugcugaugcugcugcccaccgcccuggccuuccaccugaccaccagaggcggcgagccccacaugaucgugagcaagcacgagagaggcaagagccugcuguucaagaccagcaccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaacccugguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggcauccuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguaccugaucaccgagaacaagaucuggggcagaaagagcuggcccaucaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugagaaucaaggacgaggagaaggacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagagagaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagcccgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16040 - RNA, 9879 nt, Artificial Sequence
  derived and/or modified CDS sequence (opt4) from DENV-1__JF937645__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaacccugguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16041 - RNA, 9879 nt, Artificial Sequence
  derived and/or modified CDS sequence (opt4) from DENV-1__FJ850114__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccagccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaccuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagauccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaucagcaugaagagauucaagaacgagagcgaccccgagggcgcccugugguga

SEQ ID NO: 16042 - RNA, 9879 nt, Artificial Sequence
  derived and/or modified CDS sequence (opt4) from DENV-1__JN819402__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcaugaccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacugauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagagcgagagcgaccccgagggcgcccugugguga

SEQ ID NO: 16043 - RNA, 9879 nt, Artificial Sequence
  derived and/or modified CDS sequence (opt4) from DENV-1__FJ850113__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacugauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagagcgagagcgaccccgagggcgcccugugguga

SEQ ID NO: 16044 - RNA, 9879 nt, Artificial Sequence
  derived and/or modified CDS sequence (opt4) from DENV-1__JF937635__SS-prME
agcgugaccaugcugcugaugcugaugcccaccgcccuggccuuccaccugaccaccagaggcggcgagccccacaugaucgugagcaagcacgagagaggcaaggcccugcuguucaagaccagcaccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggcauccuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugagaaucaaggacgaggagaaggacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaagaccagccaggagggccccccccccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagagagaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagcccgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16045 - RNA, 9879 nt, Artificial Sequence
  derived and/or modified CDS sequence (opt4) from DENV-1__FJ024483__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuacacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagcuucagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16046 - RNA, 9879 nt, Artificial Sequence
  derived and/or modified CDS sequence (opt4) from DENV-1__EU596504__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcuucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaugccccccgagaagugcgacacccugcugugcgacaucggcgagagcagccccaaccccaccaucgaggagggcagaacccugagaauccugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16047 - RNA, 9879 nt, Artificial Sequence
  derived and/or modified CDS sequence (opt4) from DENV-1__FJ024481__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaugccccccgagaagugcgacacccugcugugcgacaucggcgagagcagccccaaccccaccaucgaggagggcagaacccugagaauccugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16048 - RNA, 9879 nt, Artificial Sequence
  derived and/or modified CDS sequence (opt4) from DENV-1__GQ199872__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggaccacaugaccagcaugaagagauucaagaacgagagcgaccccgagggcgcccugugguga

SEQ ID NO: 16049 - RNA, 9879 nt, Artificial Sequence
  derived and/or modified CDS sequence (opt4) from DENV-1__FJ410290__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccagccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggugguguuccugcugcugaucaugggccagcugaccuggaaggaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagauucgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcugggcaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccaccaacgccaagugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugagaagauucaagaacgagagcgaccccgagggcgcccugugguga

SEQ ID NO: 16050 - RNA, 9879 nt, Artificial Sequence
  derived and/or modified CDS sequence (opt4) from DENV-1__FJ024423__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugguggccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaucaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagaaggacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccaagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16051 - RNA, 9879 nt, Artificial Sequence
  derived and/or modified CDS sequence (opt4) from DENV-1__FJ547089__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaccauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcgugcccgccagagaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucaucgacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagagugaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugagaagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16052 - RNA, 9879 nt, Artificial Sequence
  derived and/or modified CDS sequence (opt4) from DENV-1__FJ024484__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugguggccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagaaggacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgccagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugaccaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacggcuucuucaugccccccgagaagugcggcacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccaagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16053 - RNA, 9879 nt, Artificial Sequence
  derived and/or modified CDS sequence (opt4) from DENV-1__EU596503__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaucggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcauguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaccggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16054 - RNA, 9879 nt, Artificial Sequence
  derived and/or modified CDS sequence (opt4) from DENV-1__FJ024479__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcuucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccgccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgccagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaccacccccgagggcaucauccccgcccuguucgagcccgagagagagaagagcgccgccaucgacggcgagagcagacugagaggcgagcccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggcccaaggagggcgagagaaagaagcugagacccagauggcuggacgccagaaccuacagcgacccccuggcccugggcgaguucaaggaguucggcgccggcagaagaagcggcagcggcgcccugauccuggagaucggcaagcugccccagcaccugccccugagagcccagaacggccuggacaaccuggugauggugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggccaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccuguggaccagccagauccugcugaugagaaccaccugggcccugggcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaaccccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagaggccugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauggacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguggugguggacgagaaccaguggaacagcgccaaggaggccggcgaggacgagagagugugggaccugggcgacagagagagagagcugcacaagcagggcaagugcgccaccugcggcuacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagcccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcagguggccuucuggagccaccacuuccaccagcugaucaugaaggacggcagagagaucguggugcccugcagaaaccaggacgagcugggcggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16055 - RNA, 9879 nt, Artificial Sequence
  derived and/or modified CDS sequence (opt4) from DENV-1__FJ182002__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaccggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaacccagaccaaggagggcgaccaguacguguacaugggccagccccugaacaacgacgaggaccacgcccacuggaccgaggccaagaugcugcuggccaacaucaacacccccgagggcaucauccccgcccuguucgagcccgagagagagaagagccccgccaucgacggcgaguacagacugagaggcgaggccagaaagaccuucguggagcugaugagaagaggcgaccugcccguguggcugagcuacaagguggccagcgagggcuuccaguacagcgacagaagauggugguucgacggcgagagaaacaaccaggugcuggaggagaacauggacguggagaucuggaccaaggagggcgagagaaagaagcugagacccagauggcuggacgccagaaccuacagcgacccccuggcccugggcgaguucaaggaguucggcgccggcagaagaagcggcagcggcgaccugauccuggagaucggcaagcugccccagcaccugacccugagagcccagaacggccuggacaaccuggugauggugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccggcgaggacgagagagugugggaccugguggacagagagagagagcugcacaagcagggcaaguggggcaccggcggcuacaacaugaugggcaagagagagaagaagcugggcgaguucggcaaggccaagggcagcagaggcaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaaugcccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucuggagccaccacuuccaccagcugaucaugaaggacggcagagagaucguggugcccugcagaaaccaggacgagcuggugggcagagccagagugagccagggcgccggcuggagccugagagagaccgccuggcugggcaagagcuacgcccagaugggccagcugauguacuuccacagaagagaccugagacuggccgccaacgccaucuggagcgccggccccggcgacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16056 - RNA, 9879 nt, Artificial Sequence
  derived and/or modified CDS sequence (opt4) from DENV-1__FJ024482__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggcccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugauggugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguuccugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacaccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagcuucagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagcccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgccaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16057 - RNA, 9879 nt, Artificial Sequence
  derived and/or modified CDS sequence (opt4) from DENV-1__EU596501__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccugcugccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccuggagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcagccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16058 - RNA, 9879 nt, Artificial Sequence
  derived and/or modified CDS sequence (opt4) from DENV-1__FJ898437__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgugaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucaucgacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagagugaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugagaagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16059 - RNA, 9879 nt, Artificial Sequence
  derived and/or modified CDS sequence (opt4) from DENV-1__FJ024480__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugauggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16060 - RNA, 9879 nt, Artificial Sequence
  derived and/or modified CDS sequence (opt4) from DENV-1__FJ873814__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugguggccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaucaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagaaggacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagagcauccccauggccaccuacgccuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccaagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16061 - RNA, 9879 nt, Artificial Sequence
  derived and/or modified CDS sequence (opt4) from DENV-1__JN819403__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacaccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgagggccccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaaguacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16062 - RNA, 9879 nt, Artificial Sequence
  derived and/or modified CDS sequence (opt4) from DENV-1__KF973453__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucaucagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacaccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaaguacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16063 - RNA, 9879 nt, Artificial Sequence
  derived and/or modified CDS sequence (opt4) from DENV-1__KF973454__SS-prME
agcgugaccaugcugcugaugcugcugcccaccgcccuggccuuccaccugaccaccagaggcggcgagccccacaugaucgugagcaagcacgagagaggcaagagccugcuguucaagaccagcaccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaacccugguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccuggcccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagcugagacccauguucgccgugggcauccuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguuccccaucugccugagcaccaccagccagaagaccaccuggcugcccgugcugcugggcagcuucggcugcaagccccugaccauguaccugaucaccgagaacaagaucuggggcagaaagagcuggcccaucaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugagaaucaaggacgaggagaaggacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagagcgcccuggacaaccuggugaugcugcacaacagcgagcagggcggcaaggccuacagacacgccauggaggagcugcccgacaccaucgagacccugaugcugcuggcccugaucgccgugcugaccggcggcgugaugcuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagagagaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagcccgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacgugaccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgugcugugguga

SEQ ID NO: 16064 - RNA, 9879 nt, Artificial Sequence
  derived and/or modified CDS sequence (opt4) from DENV-1__KF973455__SS-prME
agcgugaccaugcugcugaugcugcugcccaccgcccuggccuuccaccugaccaccagaggcggcgagccccacaugaucgugagcaagcacgagagaggcaagagccugcuguucaagaccagcaccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaacccugguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccuggcccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagcugagacccauguucgccgugggcauccuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguuccccaucugccugagcaccaccagccagaagaccaccuggcugcccgugcugcugggcagcuucggcugcaagccccugaccauguaccugaucaccgagaacaagaucuggggcagaaagagcuggcccaucaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugagaaucaaggacgaggagaaggacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugaugcuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagagagaccugggcaucggccacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagcccgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacgugaccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16065 - RNA, 9879 nt, Artificial Sequence
  derived and/or modified CDS sequence (opt4) from DENV-1__KF973456__SS-prME
agcgugaccaugcugcugaugcugcugcccaccgcccuggccuuccaccugaccaccagaggcggcgagccccacaugaucgugagcaagcacgagagaggcaagagccugcuguucaagaccagcaccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaacccugguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccuggcccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagcugagacccauguucgccgugggcauccuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguuccccaucugccugagcaccaccagccagaagaccaccuggcugcccgugcugcugggcagcuucggcugcaagccccugaccauguaccugaucaccgagaacaagaucuggggcagaaagagcuggcccaucaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugagaaucaaggacgaggagaaggacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugaugcuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagagagaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagcccgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacgugaccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16066 - RNA, 9879 nt, Artificial Sequence
  derived and/or modified CDS sequence (opt4) from DENV-1__KF973459__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacacccugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagccugagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucaucagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggugagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacaccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaaguacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccaagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16067 - RNA, 9879 nt, Artificial Sequence
  derived and/or modified CDS sequence (opt4) from DENV-1__KF973460__SS-prME
agcgugaccaugcugcugaugcugcugcccaccgcccuggccuuccaccugaccaccagaggcggcgagccccacaugaucgugagcaagcacgagagaggcaagagccugcuguucaagaccagcaccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaacccugguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccuggcccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagccugagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagcugagacccauguucgccgugggcauccuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguacuucaucaccgagaacaagaucuggggcagaaagagcuggcccaucaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugagaaucaaggacgaggagaaggacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagagagaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaucagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagcccgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagagcuaccuggacuacaugaccagcaugaagagauucaagaacgagagcgaccccgagggcgcccugugguga

SEQ ID NO: 16068 - RNA, 9879 nt, Artificial Sequence
  derived and/or modified CDS sequence (opt4) from DENV-1__KF973461__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaugggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgagcugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaucaccgccauggcccugagcaucaucagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacaccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaaguacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugagaagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16069 - RNA, 9879 nt, Artificial Sequence
  derived and/or modified CDS sequence (opt4) from DENV-1__KF973462__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacacccugaccuacaagugcccccagaucaucgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagauggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucaucagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggugagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacaccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugagacugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaaguacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccaagagagugcuggacuggcuggagaagcacggcgccgagagacugaagagaauggccaucagcggcgacgacugcguggugaagcccaucgacgacagauucgccaccgcccugaccgcccugaacgacaugggcaagaucagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16070 - RNA, 9879 nt, Artificial Sequence
  derived and/or modified CDS sequence (opt4) from DENV-1__KF973463__SS-prME
agcgugaccaugcugcugaugcugaugcccaccgcccuggccuuccaccugaccaccagaggcggcgagccccacaugaucgugagcaagcacgagagaggcaaggcccugcuguucaagaccagcaccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacaagaugggcaugggcaccaccuaccuggcccugauggccaccuucaagaugagacccauguucgccgugggcauccuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugagaaucaaggacgaggagaaggacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaagaccagccaggagggcccccugcccgagaucgaggacgagguguucaagaagagaaaccugaccaucauggaccugcaccccggcagcggcaagaccagaagauaccugcccgccaucgugagagaggccaucaagaagaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagagagaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagcccgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16071 - RNA, 9879 nt, Artificial Sequence
  derived and/or modified CDS sequence (opt4) from DENV-1__KF973464__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucaucagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaucuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccauggugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacaccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaaguacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16072 - RNA, 9879 nt, Artificial Sequence
  derived and/or modified CDS sequence (opt4) from DENV-1__KF973465__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaugggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgagcugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucaucagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacaccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaaguacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugagaagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16073 - RNA, 9879 nt, Artificial Sequence
  derived and/or modified CDS sequence (opt4) from DENV-1__KF973466__SS-prME
agcgugaccaugcugcugaugcugaugcccaccgcccuggccuuccaccugaccaccagaggcggcgagccccacaugaucgugagcaagcacgagagaggcaaggcccugcuguucaagaccagcaccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggcauccuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugagaaucaaggacgaggagaaggacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaagaccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagagagaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagcccgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16074 - RNA, 9879 nt, Artificial Sequence
  derived and/or modified CDS sequence (opt4) from DENV-1__KF973471__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugcccccagaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacaaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgccagcaucaugaucgaggaggugaugagaagcagauggagcagaaagaugcugaugaccggcacccccgccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucaucagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaccgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacaccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccguggaggagggcagaacccugagagugcugaagaugguggagcccuggcugaagggcaaccaguucugcaucaagauccugaaccccuacaugcccagcgugguggagacccuggagcagaugcagagaaaguacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16075 - RNA, 9879 nt, Artificial Sequence
  derived and/or modified CDS sequence (opt4) from DENV-1__KF973472__SS-prME
agcgugaccaugcugcugaugcugcugcccaccgcccuggccuuccaccugaccaccagaggcggcgagccccacaugaucgugagcaagcacgagagaggcaagagccugcuguucaagaccagcaccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaacccugguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccuggcccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcgugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagcugagacccauguucgccgugggcauccuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucagaaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguacuucaucaccgagaacaagaucuggggcagaaagagcuggcccaucaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugagagacgacggcaccaugagaaucaaggacgaggagaaggacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagagagaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagcccgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagagcuaccuggacuacaugaccagcaugaagagauucaagaacgagagcgaccccgagggcgcccugugguga

SEQ ID NO: 16076 - RNA, 9879 nt, Artificial Sequence
  derived and/or modified CDS sequence (opt4) from DENV-1__KF973474__SS-prME
agcgugaccaugcugcugaugcugcugcccaccgcccuggccuuccaccugaccaccagaggcggcgagccccacaugaucgugagcaagcacgagagaggcaagagccugcuguucaagaccagcaccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaacccugguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccuggcccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagcugagacccauguucgccgugggcauccuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguaccugaucaccgagaacaagaucuggggcagaaagagcuggcccaucaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugagaaucaaggacgaggagaaggacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccgugagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagagagaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagcccgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacgugaccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16077 - RNA, 9879 nt, Artificial Sequence
  derived and/or modified CDS sequence (opt4) from DENV-1__KF973475__SS-prME
agcgugaccaugcugcugaugcugaugcccaccgcccuggccuuccaccugaccaccagaggcggcgagccccacaugaucgugagcaagcacgagagaggcaaggcccugcuguucaagaccagcaccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacggcaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggcauccuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugagaaucaaggacgaggagaaggacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaagaccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagagagaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagcccgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16078 - RNA, 9879 nt, Artificial Sequence
  derived and/or modified CDS sequence (opt4) from DENV-1__FJ898448__SS-prME
agcgugaccaugcugcugaugcugcugcccaccgugcugaccuuccaccugaccaccagaggcggcgagccccacaugaucgugagcaagcaggagagaggcaagagccugcuguucaagaccagcgccggcgugaacaugugcacccugaucgccauggaccugggcgagcugugcgacgacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaucagcuacgugaugugcaccggcagcuucaagcuggagaaggagguggccgagacccagcacggcaccgugcuggugcaggugaaguacgagggcaccgacgcccccugcaagauccccuucagcagccaggacgagaagggcgugacccagaacggcagacuggugaccgccaaccccaucgugaccgacaaggagaagcccgugaacaucgaggccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugagcggcauccuggcccagggcaagaagaccaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcguguggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggugguguuccugcugcugacccugggccagcugaccuggaacgaccugaucagacugugcaucauggugggcgccaacgccagcgacaacaugggcaugggcaccaccuaccuggcccugauggccaccuucagaaugagacccauguucgccgugggccugcuguucagaagacugaccagcagagaggugcugcugcugaccgugggccugagccugguggccagcguggagcugcccaacagccuggacgagcugggcgacggccuggccaugggcaucaugauccugaagcugcugaccgacuuccagagccaccagcugugggccacccugcugagccugaccuucgugaagaccacccugagccugcacuacgccuggaagaccauggccaugauccugagcaucgugagccugcugccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccaaggugagcugggaggaggaggccgagcacagcggcgccagccacaacauccugguggagauccaggacgacggcaccaugaagaucaaggacgaggagagagacgacaccaucaccauccugcugaaggccacccugcuggccaucagcggcguguaccccaugagcauccccgccacccuguucguguggcacuucuggcagaagaagaagcagagaagcggcgugcugugggacacccccagcccccccgagguggagaaggccgugcuggacgacggcaucuacagaauccugcagagaggccugcugggcagaagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagaaggacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcaaggccuacagacacgccauggaggagcugcccgacaccaucgagaccaucaugcugcuggcccugaucgccgugcugaccggcggcgugacccuguucuuccugagcggcagaggccugggcaagaccagcaucggccugcugugcgugaccagcagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucaucgagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugagaagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcaccgagagacugagaagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16079 - RNA, 9879 nt, Artificial Sequence
  derived and/or modified CDS sequence (opt4) from DENV-1__GQ868602__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccuucagcagccaggacgagaagggcgugacccagaacggcagacugaucaccgccaaccccaucgugaccgacaaggagaagcccgugaacaucgaggccgagccccccuucggcgagagcuaccugguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcugauccaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugaacggcgugcuggcccagggcaagaagaugaucagaccccagcccauggagcacaaguacagcuggaagagcuggggcaaggccaaggugaucggcgccgacgugcagaacaucaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcugaccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucggccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacaagaugggcaugggcaccaccuaccuggcccugauggccaccuucagaaugagacccauguucgccgugggccugcuguucagaagacugaccagcagagaggugcugcugcugaccgugggccugagccugguggccagcguggagcugcccaacagccuggaggagcugggcgacggccuggccaugggcaucaugaugcugaagcugcugaccgacuuccagagccaccagcugugggccacccugcugagccugaccuucgugaagaccaccuucagccugcacuacgccuggaagaccauggccaugauccugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccaucagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcaagagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaugggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcauggaggccuucccccagagcaacgccgccauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagaguggugcagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcugcugaagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagagccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucaucgagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaaggugcugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagaaacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucaucgacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaagcacggcaucgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagaacgaccccgagggcgcccugugguga

SEQ ID NO: 16080 - RNA, 9879 nt, Artificial Sequence
  derived and/or modified CDS sequence (opt4) from DENV-1__KF921911__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcaucaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaccgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacagcaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcgcccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcgccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacagauacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggaacagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggagaaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugagccuguacggcaacggcguggugaccaccagcggcaccuacgugagcgccaucgcccaggccaagaccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccaacguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccagcaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccugguguacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagcuucagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcaccgagagacugaagagaauggccaucagcggcgacgacugcguggugaagcccguggacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16081 - RNA, 9879 nt, Artificial Sequence
  derived and/or modified CDS sequence (opt4) from DENV-1__KJ189350__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaacggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacagcauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacaacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagagaaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagagugaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggagaacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgacagcgagggcgcccugugguga

SEQ ID NO: 16082 - RNA, 9879 nt, Artificial Sequence
  derived and/or modified CDS sequence (opt4) from DENV-1__KJ189351__SS-prME
agcgugaccaugcugcugaugcugcugcccaccgugcuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggacccccggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaccagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucgccgagaacagaaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacagcauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacaacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcgugaagauccugaaccccuacaugcccagcgugguggagacccuggagagaaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagagcagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgacagcgagggcgcccugugguga

SEQ ID NO: 16083 - RNA, 9879 nt, Artificial Sequence
  derived and/or modified CDS sequence (opt4) from DENV-1__KJ189352__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggagacagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaaggugaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacagcauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacaacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagagaaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagagugaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggagaacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgacagcgagggcgcccugugguga

SEQ ID NO: 16084 - RNA, 9879 nt, Artificial Sequence
  derived and/or modified CDS sequence (opt4) from DENV-1__KJ189353__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgagcugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacagcauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacaacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagagaaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagagugaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggagaacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgacagcgagggcgcccugugguga

SEQ ID NO: 16085 - RNA, 9879 nt, Artificial Sequence
  derived and/or modified CDS sequence (opt4) from DENV-1__KJ189354__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacagcauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacaacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagagaaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagaaguucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagagugaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggagaacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgacagcgagggcgcccugugguga

SEQ ID NO: 16086 - RNA, 9879 nt, Artificial Sequence
  derived and/or modified CDS sequence (opt4) from DENV-1__KJ189355__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaucgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaugagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacagcauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacaacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagagaaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagagugaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccugggcuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggagaacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgacagcgagggcgcccugugguga

SEQ ID NO: 16087 - RNA, 9879 nt, Artificial Sequence
  derived and/or modified CDS sequence (opt4) from DENV-1__KJ189358__SS-prME
agcgugaccaugcugcugaugcugcugcccaccgugcuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccacccaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagcccuaccagcuguggaccacccugcugagccugaccuucgugaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacagcauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagagaaagaagcagagaagcggcgugcugugggacacccccagcccccccgagguggagagagccgugcuggacaacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaaaguaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagagaaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccagcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagaacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgacagcgagggcgcccugugguga

SEQ ID NO: 16088 - RNA, 9879 nt, Artificial Sequence
  derived and/or modified CDS sequence (opt4) from DENV-1__KJ189359__SS-prME
agcgugaccaugcugcugaugcugcugcccaccgugcuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacagcauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagagaaagaagcagagaagcggcgugcugugggacacccccagcccccccgagguggagagagccgugcuggacaacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacaccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagaucgacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagagaaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacaccgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgacagcgagggcgcccugugguga

SEQ ID NO: 16089 - RNA, 9879 nt, Artificial Sequence
  derived and/or modified CDS sequence (opt4) from DENV-1__KJ189360__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacagcauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacaacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagagaaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagagugaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggagaacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgacagcgagggcgcccugugguga

SEQ ID NO: 16090 - RNA, 9879 nt, Artificial Sequence
  derived and/or modified CDS sequence (opt4) from DENV-1__KJ189361__SS-prME
agcgugaccaugcugcugaugcugcugcccaccgccauggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacagcauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacaacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagagaaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagagugaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgacagcgagggcgcccugugguga

SEQ ID NO: 16091 - RNA, 9879 nt, Artificial Sequence
  derived and/or modified CDS sequence (opt4) from DENV-1__KJ189362__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaacccugguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcaugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugagaaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacagcauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacaacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagagaaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagagugaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggagaacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgacagcgagggcgcccugugguga

SEQ ID NO: 16092 - RNA, 9879 nt, Artificial Sequence
  derived and/or modified CDS sequence (opt4) from DENV-1__KJ189363__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucauggugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacagcauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacaacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagagaaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagagugaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggagaacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgacagcgagggcgcccugugguga

SEQ ID NO: 16093 - RNA, 9879 nt, Artificial Sequence
  derived and/or modified CDS sequence (opt4) from DENV-1__KJ189364__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcaugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugagaaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacagcauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacaacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagagaaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggagcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagagugaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggagaacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgacagcgagggcgcccugugguga

SEQ ID NO: 16094 - RNA, 9879 nt, Artificial Sequence
  derived and/or modified CDS sequence (opt4) from DENV-1__KJ189365__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucguggugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacagcauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacaacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagagaaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagagugaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgacgagaaccccuggauggagaacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgacagcgagggcgcccugugguga

SEQ ID NO: 16095 - RNA, 9879 nt, Artificial Sequence
  derived and/or modified CDS sequence (opt4) from DENV-1__KJ189366__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucgccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacagcauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacaacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacagcgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccgccgccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgugaccaugcuggacguggaccugcaccccgccagcgccuggacccuguacgccguggccaccaccgugaucacccccaugaugagacacaccaucgagaacgccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccguggaggagggcagaacccugagagugcugaagaugguggagcccuggcugagaggcaaccaguucugcaucaagauccugaaccccuacaugcccagcgugguggagacccuggagagaaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccgugggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagagugaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggagaacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgacagcgagggcgcccugugguga

SEQ ID NO: 16096 - RNA, 9879 nt, Artificial Sequence
  derived and/or modified CDS sequence (opt4) from DENV-1__JN819417__SS-prME
agcgugaccaugcugcugaugcugcugcccaccgcccuggccuuccaccugaccaccagaggcggcgagccccacaugguggugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcagcacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccacgagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccagcggcauccuggcccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugaugggcaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgagaucagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccaucugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcaucagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccaacguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagaaggacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccaagaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaacgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16097 - RNA, 9879 nt, Artificial Sequence
  derived and/or modified CDS sequence (opt4) from DENV-1__FJ687426__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacagcaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccggcgccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccaacgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagaaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgagcccgagggcgcccugugguga

SEQ ID NO: 16098 - RNA, 9879 nt, Artificial Sequence
  derived and/or modified CDS sequence (opt4) from DENV-1__FJ687428__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacagcaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccggcgccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccacccugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagagcaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccaacgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagaaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgagcccgagggcgcccugugguga

SEQ ID NO: 16099 - RNA, 9879 nt, Artificial Sequence
  derived and/or modified CDS sequence (opt4) from DENV-1__FJ687429__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggaucgacguggugcuggagcacggcagcugcaucaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacagcaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccaacgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagaaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgagcccgagggcgcccugugguga

SEQ ID NO: 16100 - RNA, 9879 nt, Artificial Sequence
  derived and/or modified CDS sequence (opt4) from DENV-1__FJ850068__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacagcaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccggcgccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccaucgacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgacagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccaacgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagaccagaaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuacagcgacuacaugaccagcaugaagagauucaagaacgagagcgagcccgagggcgcccugugguga

SEQ ID NO: 16101 - RNA, 9879 nt, Artificial Sequence
  derived and/or modified CDS sequence (opt4) from DENV-1__FJ687430__SS-prME
agcgugaccaugcugcugaugcugaugcccaccgcccuggccuuccaccugaccaccagaggcggcgagccccacaugaucgugagcaagcaggagagaggcaagagccugcuguucaagaccagcaccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccauccuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacgccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacaagaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgcccuggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccagcaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaccgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16102 - RNA, 9879 nt, Artificial Sequence
  derived and/or modified CDS sequence (opt4) from DENV-1__FJ687432__SS-prME
agcgugaccaugcugcugaugcugaugcccaccgcccuggccuuccaccugaccaccagaggcggcgagccccacaugaucgugagcaagcaggagagaggcaagagccugcuguucaagaccagcaccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccauccuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacgccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgcccuggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccagcaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaccgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16103 - RNA, 9879 nt, Artificial Sequence
  derived and/or modified CDS sequence (opt4) from DENV-1__JQ922547__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagagccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgcccccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacugcgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccacccacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgccacccagaacggcagacugaucaccgccaaccccaucgugaccgacaaggagaagcccgugaacaucgaggccgagccccccuucggcgagagcuacaucguggugggcgccggcgagaaggcccugaagcugagcugguucaagaagggcagcagcaucggcaagaugcuggaggccaccgccagaggcgccagaagaauggccauccugggcgacaccgccugggacuucggcagcaucggcggcguguucaccagcaugggcaagcuggugcaccagguguucggcaccgccuacggcgugcuguucagcggcgugagcuggaccaugaagaucggcaucggcauccugcugaccuggcugggccugaacagcagaaacaccagccugagcaugaugugcaucgccgugggcauggugacccuguaccugggcgugauggugcaggccgacagcggcugcgugaucaacuggaagggcagagagcugcugugcggcaccggcaucuucgugaccaacgaggugcacaccuggaccgaccccuacaaguuccaggccgaccccagcaacagacugagccccaucaucggcaaggccugcgugaucagagugugcggcaucagaagcgccaccagacuggagaacaucauguggaagcagaucagcaacgagcugaaccacauccugcuggagaacgacaugaaguucaccgugguggugggcgacgugagcggcauccuggcccagggcgagaagaugaucagaccccagcccauggagcacaaguacagcuggaagagcuggggcaaggccaagaucaucggcgccgacgugcagaacaccaccuucaucaucgacggccccaacacccccgagugccccgacaaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgacuucugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggacaaggaggagaaccuggugaagagcauggugagcgccggcagcggcgagguggacagcuucagccugggccugcugugcaucagcaucaugaucgaggaggugaugagaagcagauggagcaagaagaugcugauggugggcacccuggccguguuccugcugcugaucaugggccagcugaccuggagcgaccugaucagacugugcaucauggugggcgccaacgccagcgacagaaugggcaugggcaccaccuaccuggcccugauggccaccuucaagaugagacccauguucgccgugggccugcuguuccccaagcugaccagcagagaggugcugcugcugaccaucggccugagccugguggccagcguggagcugcccagcagccuggaggagcugggcgacggccuggccaagggcaucaugaugcugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugcccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugguggccugcuacgugaucagcggcagcagcgccgaccugagccuggagaaggccgccgaggugagcugggaggaggaggccgagcacagcggcgccagccacaacauccugguggaggugcaggacgacggcaccagaaagaucaaggacgaggagagagacgacacccugaccauccugcugaaggccacccugcuggccgugagcggcguguaccccaugagcauccccgccacccuguucgugugguacuucuggcagaagaagaaccagagaagcggcgugggccugaucacccccagcccccccgagguggagagagccgugcuggacgacggcaucuacagaauccugcagagaggccugcugggcagaagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcagaaaccccaagaacgugcagaccgcccccggcaccuucaagacccccgagggcgaggugggcgccaucccccuggacuucaagcccggcaccagcggcagccccaucgugaacagagagggcaagaucgugggccuguacggcaacggcguggugaccaccagcggcaccuacgugagcgccaucgccagagccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcgugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccacccccaccggcagcguggaggccuucccccagagcaacgccaucauccaggacgaggagagagacauccccgagagaagcuggaacagcggcuacgacuggaucaccgacuuccccggcaagaccgugugguucgugcccagcaucaagagcggcaacgacaucgccaacugccugaagaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagcccagcaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacaaggacguggagaucuggaccaaggagggcgagagaaagaagcugagaaccugcuggcuggacgccagaaccuacagcgacccccuggcccugagagaguucaaggaguucgccgccggcagaagaagcgugagcggcgaccugauccuggagaucggcaagcugccccagcaccugacccagaaggcccagaaggcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccaccaugcuggacguggaccugagacccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcagauucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaagaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcagaauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgccaucagcagaagagaccagagaggcagcggccaggugggcaccuacggccugaacaccuuccugcacaaggaggcccagcugaucagacagauggaguucgagggcaucuuccugcccagcgagcuggagacccccaaccuggccggcagagugcuggacuggcuggagcaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggggcgacuggcagcaggugcccuucugcagccaccacuuccaccagcugaucaugaaggacgugagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16104 - RNA, 9879 nt, Artificial Sequence
  derived and/or modified CDS sequence (opt4) from DENV-1__EU482567__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcaucaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaccgcccuguuccuggcccacgccaucggcaccagcaucacccagaagggcaucaucuucauccugcugauccuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacagcaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcgcccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgccggcaagcuggugcaccagguguucggcgccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugguggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacagauacagcuggaagagcuggggcaaggccaagaucaucggcgccgacauccagaacgccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaaggaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaacaccacccugagccuggacuacgccuggagaaccauggccauggugcugagcaucaucagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaagaccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccaacguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccagagagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucuggaaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagcuucagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcaccgagagacugaagagaauggccaucagcggcgacgacugcguggugaagcccguggacgagagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16105 - RNA, 9879 nt, Artificial Sequence
  derived and/or modified CDS sequence (opt4) from DENV-1__FJ390378__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcaucaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaccgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacagcaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcgcccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcgccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacagauacagcuggaagagcuggggcaaggccaagaucaucggcgccgacauccagaacagcaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggagaaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaagaccagccaggagggcccccugcccgagaucgaggaggagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccagaaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccaacguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccagcaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccaugacccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagcuucagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcugaacuggcuggagaagcacggcaccgagagacugaagagaauggccaucagcggcgacgacugcguggugaagcccguggacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16106 - RNA, 9879 nt, Artificial Sequence
  derived and/or modified CDS sequence (opt4) from DENV-1__FJ205872__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcaucaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaccgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacagcaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcgcccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcgccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacagauacagcuggaagagcuggggcaaggccaagaucaucggcgccgacauccagaacagcaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggagaaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaagaccagccaggagggcccccugcccgagaucgaggaggagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccagaaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgcccugaccggcggcgugacccuguucuuccugagcggcaagggccugggcaagaccagcaucggccugcugugcgugauggccagcagcgcccugcuguggauggccaacguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccagcaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccaugacccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagcuucagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcugaacuggcuggagaagcacggcaccgagagacugaagagaauggccaucagcggcgacgacugcguggugaagcccguggacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16107 - RNA, 9879 nt, Artificial Sequence
  derived and/or modified CDS sequence (opt4) from DENV-1__FJ205873__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcaucaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaccgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacagcaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcgcccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcgccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacagauacagcuggaagagcuggggcaaggccaagaucaucggcgccgacauccagaacagcaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaaagcugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggagaaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagguggugggccuguacggcaacggcguggugaccaccagcggcaccuacgugagcgccaucgcccaggccaagaccagccaggagggcccccugcccgagaucgaggaggagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccagaaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccaacguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccagcaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccaugacccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagcuucagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcugaacuggcuggagaagcacggcaccgagagacugaagagaauggccaucagcggcgacgacugcguggugaagcccguggacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16108 - RNA, 9879 nt, Artificial Sequence
  derived and/or modified CDS sequence (opt4) from DENV-1__FJ390379__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcaucaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaccgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacagcaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcgcccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcgccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcagaaagaugaucagaccccagcccauggagcacagauacagcuggaagagcuggggcaaggccaagaucaucggcgccgacauccagaacagcaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggagaaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccaucagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaagaccagccaggagggcccccugcccgagaucgaggaggagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccagaaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccaacguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccagcaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccgugcccauggccaccuacggcuggaaccuggugaagcuguacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccaugacccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagcuucagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcaccgagagacugaagagaauggccaucagcggcgacgacugcguggugaagcccguggacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16109 - RNA, 9879 nt, Artificial Sequence
  derived and/or modified CDS sequence (opt4) from DENV-1__FJ390380__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcaucaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaccgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacagcaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcgcccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcgccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacagauacagcuggaagagcuggggcaaggccaagaucaucggcgccgacauccagaacagcaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgagcugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggugguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggagaaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccaccuucuucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaagaccagccaggagggcccccugcccgagaucgaggaggagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccagaaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccaacguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccagcaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccaugacccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagcuucagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcugaacuggcuggagaagcacggcaccgagagacugaagagaauggccaucagcggcgacgacugcguggugaagcccguggacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16110 - RNA, 9879 nt, Artificial Sequence
  derived and/or modified CDS sequence (opt4) from DENV-1__FJ205874__SS-prME
agcgugaccaugcugcugaugcugcugcccaccgugcuggccuuccaccugaccaccagaggcggcgagccccacaugaucgugggcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagaucccccugagcacccaggacgagaagggcgugacccagaacggcagacugaucaccgccaaccccaucgugaccgacaaggagaagcccgugaacaucgagaccgagccccccuucggcgagagcuacaucaucgugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcgccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcgugagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggagacuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugccugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccguggcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggagcagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugaagagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugaugcuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgugaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaagacacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccugggcaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcugugggacuuccugagcagaaacaagaagcccagaaucugcaccagagaggaguucaucagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagaccaccaaccuggccgagagagugcuggacuggcuggagaagcacggcguggagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16111 - RNA, 9879 nt, Artificial Sequence
  derived and/or modified CDS sequence (opt4) from DENV-1__FJ205875__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcaucaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcaagaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggagaaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggagcaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaagaccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccaacguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagauggcugguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggugcacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagcuucagcggcguggagggcgacggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaagcacggcaccgagagacugaagagaauggccaucagcggcgacgacugcguggugaagcccguggacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16112 - RNA, 9879 nt, Artificial Sequence
  derived and/or modified CDS sequence (opt4) from DENV-1__FJ410173__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcaucaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaccgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacagcaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcgcccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcgccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacagauacagcuggaagagcuggggcaaggccaagaucaucggcgccgacauccagaacagcaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggagaaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccaccuucuucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaagaccagccaggagggcccccugcccgagaucgaggaggagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccagaaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccaacguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccagcaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccaugacccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagcuucagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcugaacuggcuggagaagcacggcaccgagagacugaagagaauggccaucagcggcgacgacugcguggugaagcccguggacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16113 - RNA, 9879 nt, Artificial Sequence
  derived and/or modified CDS sequence (opt4) from DENV-1__FJ410174__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcaucaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaccgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccaucgccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacagcaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcgcccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcgccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacagauacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaucaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggagaaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaagaccagccaggagggcccccugcccgagaucgaggaggagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccaacguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccagcaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccgcccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccaugacccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagcuucagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggaggccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcaccgagagacugaagagaauggccaucagcggcgacgacugcguggugaagcccguggacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16114 - RNA, 9879 nt, Artificial Sequence
  derived and/or modified CDS sequence (opt4) from DENV-1__FJ410175__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcaucaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaccgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacagcaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcgcccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcgccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacagauacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggagaaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaagaccagccaggagggcccccugcccgagaucgaggaggagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccaacguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccagcaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccaugacccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagcuucagcggcguggagggcgagggccugcacaagcugggcuacauccugagagacaucagcaagauccccggcggcaacauguacgccgacgacaccgccggcugggacaccagaaucaccgaggacgaccugcagaacgaggccagaaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcaccgagagacugaagagaauggccaucagcggcgacgacugcguggugaagcccguggacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16115 - RNA, 9879 nt, Artificial Sequence
  derived and/or modified CDS sequence (opt4) from DENV-1__FJ562105__SS-prME
agcgugaccaugcugcugaugcugcugcccaccgugcuggccuuccaccugaccaccagaggcggcgagccccacaugaucgugggcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagaucccccugagcacccaggacgagaagggcgugacccagaacggcagacugaucaccgccaaccccaucgugaccgacaaggagaagcccgugaacaucgagaccgagccccccuucggcgagagcuacaucaucgugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcgccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcgugagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugccugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccguggcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugaugcuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgugaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugggcggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccugggcaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcugugggacuuccugagcagaaacaagaagcccagaaucugcaccagagaggaguucaucagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagaccaccaaccuggccgagagagugcuggacuggcuggagaagcacggcguggagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16116 - RNA, 9879 nt, Artificial Sequence
  derived and/or modified CDS sequence (opt4) from DENV-1__FJ562106__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucauggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcgccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaagaacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucggccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccaccuucagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccugcgagcuggagacccccaaccuggccgagagagugcuggacuggcuggagaagcacggcgccgagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccaccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16117 - RNA, 9879 nt, Artificial Sequence
  derived and/or modified CDS sequence (opt4) from DENV-1__FJ410179__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcaucaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaccgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacagcaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcgcccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcgccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacagauacagcuggaagagcuggggcaaggccaagaucaucggcgccgacauccagaacagcaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauguacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggagaaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccaucagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaagaccagccaggagggcccccugcccgagaucgaggaggagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccagaaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccaacguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccagcaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccaugacccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagcuucagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcaccgagagacugaagagaauggccaucagcggcgacgacugcguggugaagcccguggacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16118 - RNA, 9879 nt, Artificial Sequence
  derived and/or modified CDS sequence (opt4) from DENV-1__FJ410181__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcaucaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaccgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacagcaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcgcccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcgccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacagauacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggagaaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaagaccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccaacguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccagcaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccugguguacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagcuucagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcaccgagagacugaagagaauggccaucagcggcgacgacugcguggugaagcccguggacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16119 - RNA, 9879 nt, Artificial Sequence
  derived and/or modified CDS sequence (opt4) from DENV-1__FJ547086__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucauggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcgccagccugagcaugaccugcaucgccgugggcauggugacccuguaccugggcgugauggugcaggccgacagcggcugcgccaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccagcagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccugcgagcuggagacccccaaccuggccgagagagugcuggacuggcuggagaagcacggcgccgagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcaaccccgagggcgcccugugguga

SEQ ID NO: 16120 - RNA, 9879 nt, Artificial Sequence
  derived and/or modified CDS sequence (opt4) from DENV-1__FJ410183__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcaucaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaccgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacagcaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcgcccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcgccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacagauacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauguacggcggccccaccagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagauggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggagaaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaagaccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccaacguggagccccacuggaucgccgccagcaucauccuggaguucuuccugauggugcugcugauccccgagcccgacagacagagaaccccccaggacaaccagcuggccuacguggugaucggccugcuguucaucauccugaccguggccgccaacgagaugggccugcuggagaccaccaagaaggaccugggcaucggccacguggccgccgagagccagcaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagcuucagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcaccgagagacugaagagaauggccaucagcggcgacgacugcguggugaagcccguggacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16121 - RNA, 9879 nt, Artificial Sequence
  derived and/or modified CDS sequence (opt4) from DENV-1__FJ410184__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcaucaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcgcccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacagauacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagagagaggagaaccuggugaagagcauggugagcgccggccugggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcgccuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaagaccagccaggagggcagccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagcuucagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcaccgagagacugaagagaauggccaucagcggcgacgacugcguggugaagcccguggacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16122 - RNA, 9879 nt, Artificial Sequence
  derived and/or modified CDS sequence (opt4) from DENV-1__FJ410185__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcaucaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacagcaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcgcccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcgccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacagauacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggagaaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagaggagaagaucgugggccuguacggcaacggcguggugaccaccagcggcaccuacgugagcgccaucgcccaggccaagaccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccaacguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccagcaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagcuucagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcaccgagagacugaagagaauggccaucagcggcgacgacugcguggugaagcccguggacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16123 - RNA, 9879 nt, Artificial Sequence
  derived and/or modified CDS sequence (opt4) from DENV-1__FJ547087__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucauggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcgccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggacggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugaccaucagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccugcgagcuggagacccccaaccuggccgagagagugcuggacuggcuggagaagcacggcgccgagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16124 - RNA, 9879 nt, Artificial Sequence
  derived and/or modified CDS sequence (opt4) from DENV-1__FJ410186__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagguggagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucaucgugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcgccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaccagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggccuguggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccagagccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugagaagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccguggacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgaccccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaucagcaugaagagauucaagaacgagagcgaccccgagggcgcccugugguga

SEQ ID NO: 16125 - RNA, 9879 nt, Artificial Sequence
  derived and/or modified CDS sequence (opt4) from DENV-1__FJ410187__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcaucaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaccgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacagcaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcgcccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcgccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacagauacagcuggaagagcuggggcaaggccaagaucaucggcgccgacauccagaacagcaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggagaaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaagaccagccaggagggcccccugcccgagaucgaggaggagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccagaaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccaacguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccagcaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccaugacccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagcuucagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcaccgagagacugaagagaauggccaucagcggcgacgacugcguggugaagcccguggacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16126 - RNA, 9879 nt, Artificial Sequence
  derived and/or modified CDS sequence (opt4) from DENV-1__FJ478457__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcagcacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcauguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccagcggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugcagcgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccgugaucguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccauggccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacaugcugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccaggugauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagaaguucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcaccgagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgaguggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16127 - RNA, 9879 nt, Artificial Sequence
  derived and/or modified CDS sequence (opt4) from DENV-1__FJ410188__SS-prME
agcgugaccaugcugcugaugcugcugcccaccgugcuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcagcacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcauguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccagcggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugcagcgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccgugaucguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccauggccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacaugcugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccaggugauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagaaguucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcaccgagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgaguggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16128 - RNA, 9879 nt, Artificial Sequence
  derived and/or modified CDS sequence (opt4) from DENV-1__FJ478458__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcaucaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaccgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccauccugagaaagcugugcaucgaggccaagaucagcaacaccaccaccgacagcagaugccccacccagggcgaggccacccugguggaggagcaggacagcaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcgcccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcgccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacagauacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggagaaccauggccauggugcugagcaucgccagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaagaccagccaggagggcccccugcccgagaucgaggaggagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccaacguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccagcaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccaugacccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagcuucagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcaccgagagacugaagagaauggccaucagcggcgacgacugcguggugaagcccguggacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16129 - RNA, 9879 nt, Artificial Sequence
  derived and/or modified CDS sequence (opt4) from DENV-1__FJ410190__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcaucaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacagcaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcgcccaggacgagaagggcgugacccagaacggcagacugaucaccgccaaccccaucgugaccgacaaggagaagcccgugaacaucgagaccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcgccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacagauacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggagaaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagaggagaagaucgugggccuguacggcaacggcguggugaccaccagcggcaccuacgugagcgccaucgcccaggccaagaccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccaacguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccagcagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagcuucagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcaccgagagacugaagagaauggccaucagcggcgacgacugcguggugaagcccguggacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16130 - RNA, 9879 nt, Artificial Sequence
  derived and/or modified CDS sequence (opt4) from DENV-1__EU482591__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacagcauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacaacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagagaaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgacagcgagggcgcccugugguga

SEQ ID NO: 16131 - RNA, 9879 nt, Artificial Sequence
  derived and/or modified CDS sequence (opt4) from DENV-1__EU482592__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcaucaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaccgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacagcaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcgcccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcgccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacagauacagcuggaagagcuggggcaaggccaagaucaucggcgccgacauccagaacagcaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggagaaccauggccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaagaccagccaggagggcccccugcccgagaucgaggaggagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccagaaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccaacguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccagcaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccaugacccacagaaagcccaccuacgagagagacguggaccugggcgccggcaccagacacguggccguggagcccgagguggccaaccuggacaucaucggccagagaaucgagaacaucaagaacgagcacaagagcaccugguacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagcuucagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcugaacuggcuggagaagcacggcaccgagagacugaagagaauggccaucagcggcgacgacugcguggugaagcccguggacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16132 - RNA, 9879 nt, Artificial Sequence
  derived and/or modified CDS sequence (opt4) from DENV-1__EU482609__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccagagccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugaagggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16133 - RNA, 9879 nt, Artificial Sequence
  derived and/or modified CDS sequence (opt4) from DENV-1__EU482610__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggugcugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16134 - RNA, 9879 nt, Artificial Sequence
  derived and/or modified CDS sequence (opt4) from DENV-1__EU482611__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggaagcagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaagcugaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16135 - RNA, 9879 nt, Artificial Sequence
  derived and/or modified CDS sequence (opt4) from DENV-1__FJ639735__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaccgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucaaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagaaggacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucgugauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagagagaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16136 - RNA, 9879 nt, Artificial Sequence
  derived and/or modified CDS sequence (opt4) from DENV-1__FJ639740__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaacccugguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucgccacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgaggaggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16137 - RNA, 9879 nt, Artificial Sequence
  derived and/or modified CDS sequence (opt4) from DENV-1__FJ639741__SS-prME
agcgugaccauccugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcaccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccaaggccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccugggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucuggaaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16138 - RNA, 9879 nt, Artificial Sequence
  derived and/or modified CDS sequence (opt4) from DENV-1__FJ639743__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugauggcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugagauacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaaggugaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcuggugaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcagaaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugagccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgaggaggccaaccuggacaucaucggccagagaaucgagaacaucagaaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 16139 - RNA, 9879 nt, Artificial Sequence
  derived and/or modified CDS sequence (opt4) from DENV-1__FJ639794__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucguggugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaaccugggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugaagggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggugcacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcuggugaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga
